United States Patent 9,567,581 (SELECTIVE REACTIVATION OF GENES ON THE INACTIVE X CHROMOSOME) - sequence listing, part 50

SEQ ID NO: 5505 - DNA, 24745 bp, human
gggtgtcctccccacagcaccacggcttctcttcctcagcacggcgacaggggcttccccttcgccgccgccgccgccgccggccaagctccgccgcgcccgcggcccgcggccgccgtaagtccctgggggcgaaagggggcgccggggatgggggagagggggagggaggactgggcgcgccccccgccaccccgcgcgcgccccgacgaccccaccccgagcctgcccggcccgccactgggtcgccgcgcccgcaactcacttctctccgtgtccgcgccctccgcaccactccgcgccgcgcccggggatgtgggggccagtcccgggctccgcgacagcctcgcggcacctgtggttcgggaatcgcctcaagttttgcggggcgctttcgggaggggccgggggcggtggcggccgaggactcttggcgccccctgcgcggcggcggatgccattgtctgctccgctccttgcctgtcacctctcccgggcttggtcagtgatggagtgtggccacgggagtgggggggaggcaccggcgacggccggacccgaggaacgctggccccgagcccgcgccgcggctgagcccattgtttttaatgccagtctcgaggaattgtggtgccctgtgatttgcggcaaaatcaaagcgttggtttttaacacgagggaaggaatactcgtgctttgcaaccgggtttcgtcccatgttaggacataatttattttaaggagaatacattgttttttcgtcctgcaaagtggtagggcggatacaggaccctgctccagacagccttgagcccatactcttcgcaggcaaaccctcaccctttctggtcaccaagatctaggaatacgaggtccattcttttccaagttctggtaacgggtttgcagtaaatgcccagttgatgcttcacttcctgcccccttcgaatgccgctatcttcaggacttgcacgggaggcactttggtatcacctaataatgtccttatattttgttcccctgacgcattttaagtgaggtaataagaccattttaactttactaaagttgaattgccacgtcatacatttctagatatcttgttgatacctttttgggtggttacaaaaagcgacgataatttcttaccgaaatttagggcccatttttattctacattggttctgtaaatttcccctccccgtgttcaaattcaagatggtgtggtgaatcttgagaatcatgcttgaatcttatttgcagtaacgctgttaaaggaacttaacagtgattaaaagaaaaaaggatacctatgtgaattctgcctttaaattacctttgtagaaacaatacttctgtttgcagttgagatgaccaattggattacaaaaagcttggcgttaaaaatgaaacatgcagactaatcaacacatttgcagatcacaaataaatacatacaaattagtttaagtataaaacacactagaattcagcatccattccatctgtagatactattttttattttaaatgaagtatttcatgtaatgtttcaatgctgaatcttatttaataagtgtaaatcttattgtggccttttaaacgtttgttttctttttcataatacattaactcagttctagattttgtacatatttaagttggaatgctttaaaagtcagatgaaaacatacttttttattaatgaaaatttgtatttatgggatttttcagttaatattttggatcattctgttttgcttaaaatatgccatcataaactgaggagaacattccaagacataagctactgtctgcaagtaattcaccctggaactagaacggcctcaggatgaaaaatagcaggtcttctgtttctttcaaaagtacccaaaccagatgatgtctaccattctcttttgatgcatatagagagtgcgcaatgtatagcacaggtagaaaatagtttcttaaattgaaagagtgatctttatttttcttcaaaaatttcacttcagcttattacccatttttcttttttctcctgcacactccccttcaaacttaatgtggaacaaggtgggattggaaggtttgcatctagaggaagatctgtccaaaagaatttcttgctattttaattggcatagaaatattgatggctactaatcatttgtcatgtaaatgccccatcccccaaaacttctctgtgaaacacataatcttaactttattgattcaaagtattacatgtaatcttgattttatttatcttaacagatgcagtttatgttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaaggtataatttttgtttgtcagaaaggtgaaatagaatcaaatgttaggtcatttaggaaattgcagacttcagtgatgacatttataaataacgattaataaagatttagatgaaataggtttaaggtaaagctttgtgtttttaaaataactagtgttttgattgataattactgaggctgaaatgataaaggcagggaaatcctttgaaaactagttatataattaaaggcataaatgattattcatgcttaatcatctttatagaagagtttaatgaattcatttcattgcaggggaaagtagggtcagtattttaaattgtgtgagtaattctctgaattgagacaagtacagatagagtctaattctttttccccgaaaatctataaagtaatgactaatatttgacatgccttttatctgatttttagaatcttactcacgtgtaaataccttgactatgtagactatttcaatcacatagatgttttaaaaactttgtgtatacatgagatgtgtttgtaagtagtgtttattaacttttaagtacccttgttgctatggtgggggtgcaattaaatatgacagataatttttccaaggacagattttttaaaaatttgatgttacaaaatgactcatagattggcttttaacactaaaatttttttaatgctatacgtctttattttataaatatctgaaaccctgaataccctaaaataaatttctcaagattgttctaagtaggttaaaagaaataaactttcttcttttacagaacattttttgaggggacatttacttcattccccatttgtttctttttgaataatttgctgaatttaagataagagcatttctgcatataaaaagttctcttgtgtggggagtatacatggaagtaacagtatgggatacaatgagggtgggagagaagtctggttttcttctcagcttccctttattgcactccaaatatgggttggatattttgtcagggagatggctgggaagaaatggagattacaagacataagtttcttaaatactgaggactcctctttattattgaatgatctttggtgattttgtatctttgggtgattttgtatccagtgtttcgtttggtcttattaaagattatagaaaagtcatatcatttgagaggtgagagatgttttacagtgatctagtcaggtgattttgttttgttttgttttgttttaagctttttgccccatgggtagaaccttaaataaaatgagtggaagtgaggctgctccttgtgaaatcaggaatgaggatcctgtatcctggctcacttggcctttacccctctgcacaggagacagttcttgagtttgaaaactgccgttgttgatcaaacttcaattttataaagaatgcaaatttgggagaagtgacttgtctagggccatatgccagttagtgattgacatggggctgcaactcagatcttaagcttagaggcaaagattttaaacagggctggaaaaagatcaggtttacatatcttaaaagattgaactgagacaatggatgagggcaggaggggctgagactggcacctgcaggatcagtaggagactatgtgagatcctgaacccaggcgctagaaaggagggctgtcactaaatagccattatcaaataggtaggtttgataagacttggtcacctctagaagtgggaagaatatgggaggtcgaggcaggagaatcgcttgagcccaggagttcaagtccagccctggcaacttagtgagaccccgccgtctctacaattaaaaaaaaaaaaaaaaattagctgggcgtggtggcatgcacctgtattcctagctgctctggaggctgaggtgggaggattgattgtgcctgggagttcaagcctgcactgagccctgattgggccactgcactccagcctaggtgacagagtgagaccctcaacgacaacaacaaagcggagagagcagcgaaggaaagggaggagtggggtgatctccacatttctggtttgctgatggggtacaaggtgagctagataactcggcttattttggggtgagttgatttggggatgtctatgtgactttcattaagagaagcctgattttctggtgggatgtggttggtgtaagtatggaagtctggggaaaataagacaaagtattagatcaccagcattcaagtggcaggcaaaggagatgaagaagggaccttcagagtggaatgagaaatttcaccaatgccagatgttgcataaagttcaatgaaagtgaggaaggaatctggtagattttacagtgagcatttcatataatgccctttgccagaacattttcagtggaatagtggagatagaactctcgatgtaatggggcgaagtgtgaagaggtggagaaatttaaatagcatgtgtagactattttggggaactttgctgtgaaggacaggagacgaggtggtaaccactcatagacataggagtgggggacaaggtttttaaaaaagaaggtgtgagaggcttaagcttatttctagataggggaaggagtcccccgtgtggaggaggaaaataccagcaagggattcaatcccaggaatgggctgttatgggaagaaaggaaagcactgcttggtgttcatgcacatgtcactcagtctgtccgtgttgagccactactttttcttttgaaagctacaaagggtatctaatccaactctgatacttatatcaagcacctttaaataaaaggtggactttaaaaaaaacagctttattgagatatcagtcatatacaaaaggtggaatttatcagttctttctctatacgttcccccttccatttcatactgaaaacctcatctactctaccacttacggacatattttttgttggtataaacaggtggtttgttttccctactgctggaagcgaagagctttttaagcaggagaattactgcttagcgcctgagaaattctggactgggacttctgctgttcatatcagcaagtgatttttgttgtttttgttaaattatctcatctacattcttcatcctgagtatttggcatacaaattcccccttttgagaggggaatgatggataagaataatattagctgaaaagacagactgaaaatctggggacttaagttctgttccctttgtaacgttagctagttttatgactttaaacaagtcactttgtttccttatctctaaatgctcttgaagatcccttcaagacagaatactgtgcttttttgattcctgttttgtgtagcattttgtggaagagtcactggattaaggtcttttaaaattaatttaaaaacatatatatctccaaattactagcttgataatttgttaaagaatacttactgattttctttactaacaaaagaatttttaatgacataccagtgggtattgagaacacttcagctacattcacccacagtcagctgatatttagctgatatttagctgactgcggagaagtcatgtgttttgaatataagaataggcactttcagatgttctctgagtgccagtaattagagtaagccttaatccactgtgctaaaaataaccaaacatacctttcttcttactagtctattattaattttacttcagatttagacttacaaataggcactaagagaacaaaatgagctcattattgatttttttaaaaccatttggtcctaaatataggaagtacacttcaggttctcttggtaatcttttactaaatcagtatggcatattttacttctcttcaaagctcttaaaatattgtttcgagcacattttaatttttgccaggtatgggattacgttaatgcaattgctggctatagtttttaatgtaaaacttgggctctagagtcaaattgctgttcctaggcaggttactcaaacctgggtctcttatcaatgcaaataataatggtatctcatggatacggttgttgtgaggattagagtggtaaaatatgcaaaagccttagctaacatttaatgtctcatgtagggcgaggattcagtgaatggtacttaattattatgtttctgtttttttcctgccctaagctttctggaaagaggtacattattatcctgatagctatctgttcacctacaccaaagaattcattaatttgattattctttttccattccgagtgaaagtaaacattactggctggggcttagacacattgtttctgatgatttttaaattaatgcttccaagtgattcatgcagtttaggacctttgactagtgtttaagtgctttttatttgtaagtaaagaggcagtactgtggataaggagcgaggatggtacgagcattagcttgtttaatagtagcatgaggaaatcttaaataaaaggaattttacttgaaactgttagtaaactttgtataataaattatttagcattctgttcctatcagctagtcatatctggtttttaatctaccatttttatgtcagtccctttaatgtttagttttcttaaatcagggaatcttatgtgtcatttatcagtttcctcaaattcaaagttctatttaatgagcatgggttagggaggatggagagttggaatactctattctcttttaaatagacaaacaaaaacagtaacgatgggaaagagagggagcactttgttaaagttggcattgatgccctgttttgtcttccatgacttattcccttcacaatgatgataaatgaacacatgtgaatacctcctctcaataagactgcagtagctccaccattttaaataacttactgagtgtggaagtcaggtagagtagacatgcacaaactcatgatatatatgccaagtgagtttgtatgatacagtggaaaaaggcctggagttaaggtcaaaagatcaggtttcttatcccagtactagcacttgtaggcgctgtactcttaagcctcattttttttttgtctttttttaatctgtgatcaaggatgaaagatagtacttgctgttgaaaacatcaaataagatgaaatggttttaataatgaaattaatgctgttgtgtgaatactagttattttcatactaaggagcaagaattcattgagtctcaaaacaggttgtgttattctgtatacagtattattttacattaatgctacgagcagtaactgcccattgtgttttctaaaaatcatttaagtgatcttcagtgaaaattataatctccactgaaatgttctgtgtttagcctatcttaggtttttattttctttcttttcaaaagccttaagtacatgtaaaccattttaaaatgcccttttaatcctcctcaaaggacttgctatgcctcagggttgaagttttgcttccttgggtcaagcataacatgattccatatgctagaatcctaatttgaaggagaatataagtttcccaaccttattccctcttctagggtaaataaactacacttcagttcaacagtgtagaacttggtaaatttgagaacaggcctctgtttcccttaagtgataggaactttctgttctctttctctaacttctgtaataacgtggagctgttgttcttttcgtatggtttattctgcaatcctagaaacctttttaaaaacaattctattctgttagaagtcaagagcatagttacccttgggggtgggaggttgtgactgggagagggtagcagaggagtttcagggttcagtagtgttcagcttcttgatgtgggtgctgatatatagttgagttcactttgaaaatttattgagcttgtaggacttaaggtcttctctgtgtatatattatacatattccaataaaatatcccaaaatattgacctcaccttggcattatcctcaacaagtcctccttcagttggaaggtttgttttcttctctgtacttacagtttgaattaatctgctatatattttgttttaattaagtaaacttaggaaaaacctgggtctgctatgttttaaaatgcttatagaaaagaacctgaaaggaagaagggcaaaatcacttattctaagtggtatgattattttgattttttctttatacttgcctatgcttttcaaaatttctgttatgcgtttattacttttgtagtctatgagaaaaatctgtactgtcgtgaaagaagaaataaactgtataaacttggggcttttcataataggatatgaaaatatatttagaaaacatcattataggataacagtttttttcacatttgtactttgttacagatatgctagtctgtatttttgctgtgctattgaggatcaggacaatgaactaattaccctggaaataattcatcgttatgtggaattacttgacaagtatttcggcagtgtgagtagtattttattttaggaaattgaatgccatagtatattttggaaccttttctctaacaagtttattttttggttgtcttggggattctaaccgcgggagagggtgggaatgactatttattagtagaaattattaagttgtccatattgggaacatgcagagcccagtcttatttagcttgtaggaatatgttttcaagtacttgagatttggaaattaagcttacttaaaccagtgatacttagtcatttttagaaagagttaagattgattcactctagttcgattttattcactacctgatagtgaataagcatcttctgcttctgcaagttttaacaattttttcttttcttttttcttttttttttccttttcaggtctgtgaactagatatcatctttaattttgagaaggcttattttattttggatgagtttcttttgggaggggaagttcaggaaacatccaagaaaaatgtccttaaagcaattgagcaggctgatctactgcaggaggtaagctacttattctcttcactaggcactagcatgttttgctcttgctggggaagtctcattcatcattcttacagtttcagaaagtactctgaagcatgcttgtcatgtagtgtccatccatgtgcagtttattgactggaatatgtgtcagtcacgtcaactcagttatctatggatggatggttcagtttggagatggtctatcggtcaggcctcttcccaatggccctttttggaccctaaaacactggagtctaaacctttagaggacagactatttgaagaagggaaaagattggctgaaagtagcagtaagttgagaactctccatctattgcttcaaattgtttaagataaccccctttttcattagtgtagataatcaggagttgactatgagattatgacattttaattccaaattggctcatatttttacctcatgtccattaaatgcaaaagtagccaagcaaatgatagtgttttctaattatactttttgtagaaacttccaggttttttttgttagcaaaactaaacagtatttgcatttctctttgctcttcttaaataacaaaccatgttctgtcaaactgcattcttgtcttacctccatatccccagatgtgtaactcccttttctttctaattaccatagtcatcttgggttaattgtgcagttgatgctgatgtaccttctatttctgaagcttaacatttcatagataaggctacctttttccaaaaacttaatgataccttaattcagataccaaattgaattatgctttagagctaattgtgatttttatcatatggaaagcttacagcatgagaagtgattagtaaatattgaaaaatgaaatgtgttttcactaaagtagttgttaagtgtgtgtttgcatgtatgtaaaagtcttgaatatttttggctcactggttcattttccagaagcattgaaaatatgattttgtatttccagtttattttagtcccttctttgttacatacatgtttatcagtttgttcttgtctttttttagtcaccaaaggtgactttcagtcccattttttagccttggaggcattcagttttaagggagtgaaataaggggagaagagtaacttactttctccattttaacttcttaactcttggactctgtgaggaagggaaagctgtttgagaatctcactgcatcagtcactgactgggacagttgtggggattgcttgaagttgagatgacatcatctggatagacatctactaaatgtgagacaatgcattgtacacttaatgatcttgtagttatcagaagagtggttaaggtgcctgcaaaagtgaagtattagattggcagccctggtgccatctactcttcagtagtgaaatgaacacagaccttttgccttgtgtgtacagtttgccacagtggtttaccaattgattggaaatgttattctggaggtttgtttttaatatcaggtgcgctgactataagcatatactctactgttgtaaaattggtttttaaagttagtatctccttattttgctgttcactaatcagacttttttaaaaattaggtcaaaaccaggattagaaattgggaatttttcatataggtcttcccttgatcactttcatattttgtcacagatctgtattctgctctgtcagaacctggcatttcttccaagtttttctatcattttctgattaattacattggctttaaaatgtatttaaagttattgaagttcaacttttaattttaatatttttcctggagagtaattttttgtttgtttgtttgagatggagtttcgctcttgttgcccaggctggagtgcaatgacacgatcttggctcactgcaacctctgcctcccgggctcaagcgattctcctgcctcagcctcccgagtagctgggattacaggcttgcactaccatgcctggctagttttgtacttttagtagagacagggtttcaccatgttggtcaggctggtctcgaactcctgacctcaaatgatccgtcccccttggcctcccaaagtgctgggattaaaggtgtaagccactgcacccagctgtgcctggatttttaaatgctactgggaaattgctatgggccttagaatatgacagcaatgttaagtttaccttagagcatatattcagtatttaatgtactaggggataagaacattattgcagatccacatttatttgtgtgtgtatatgtacatatgtatatatattcccctatgggagtattttaatagttaatattgtccttctgtttgaagtactatttttatgtctttttttttttttttttgagatggagtttcgcttatcacccaggctggagtgcagtggtgcaatttcggctctctgcaacctccgcttcctgtgttcaagcaatcctcctgcctcagcctcccaagtagctgggactacaggtgcacaccaccatgcccagctaatttttgtatttttagtaaagacaggctttcaccatgttggccaggatggtctcaaactcctgacaggtgatccacccacctcggcctcccaaagtgctgggattacaggcgtaagccaccgcatccagcctatttttatgtctttaattggggaaagtaagtgcaaagagaaaagcataggatgagtatggttggtcccatgtaaaattttccttacccccttgtaacctttgtttaaaataaagaaatgagtactgttaattacagttccttgtctttagaagaaagctgtggtcctgtttctcttctatgactacttttacattgctttgtacacaaacgaaactgagtaccacattgagacattgtctatttagcagtctgagtgaaccatttttcttagccatgtaggtcttggggaagcagtaggtggtggtccattctgaatttagagtgagaatacatcgtaggttaaggccattatgaagccaagctcaagtctgtgtggagcagtaaggcttcaggttattctgttctcttcatcaacatactctgagaagaaatgcaggaatggcaagatgcatgtttcctaaaaatagattcatttatatttttgatgcatgatacaagtttacatctgtgggagagtatttgaatattatgttcataaaatagcaagtggaataagagaaaaagcactccacaaactgctggaaaactttttgttttggataccatgacaacaaaaataattatgatggtaactaacgcttgagtgcttgtatgtgaggccctgggctcagcagtttgctttaagcatcctgtgctaatcctcaagacaccctgtgaaaggttagaggtagcctaatgagaaagtggaatctcagtgaggttccatgactggtctgaggccacctggttagcaactggcaaaaccaggattctaaacccagatctactaggcttcacagctgtgtaaaatcttaaccactgtgcacttcccctaaccccagttatgtattgtcttggtatatatattttaaacgttctgttttagatatgaacttctttgtttctcagtcatatagtgagaaattcataattctcccagaggtttttctgtgtggaaaagagtagatttcctaagacagtgccatctttgacttcttagactgcaaatttttattgtccagattatcagcagttggaattttttattggatatgtagatataaataatatttttcaacctatttcttgttggattgatcaaaatgcctggatttataataacttttttggtcttatagtttggggtatagcattcacttaatcaatttcatgaaatgattttgcttccaaaattgtaaatatagctgtgaagatctaaattcagacttacatttgtagtagaagtcctaattggtcaattttaatctactttttcatgtgtcattatttttctgtttagtgtcaggtcttttacttgaattgattatttctaagcaccaaagatgactttgaacttatcatgtacttatctgttggcttaaaggtgtatacacatctcaatgattttgatttttttttaatttgtgaaatatacatttctatccttaagaatgcttattttcttcagaaaaattaaaaaaaaatttctcttacccaatttgtataaacacatagtttaaggtagtccttcattttatagccaaatagggaagagggtcagtggatacagattttctgttagcatattacagttagtaataaaaatgtaacattaaatgtacattcaaataatagttgctaaaatattagcagatattgtgattagataataaagatatcttttttattttacttcattacttggtaaataaaggattagttttgacatttctagaccaaacttcatgtttattccttttggtgtttggttgtatgaatacataattagatttgggggtaaagcccagaaattggcccgttatccattttttaatgtttggctgtcttaacatgccactggtactaaagatgattcttaaattattaaagtacaacatgctgaaattgctaaattgatattctttgcaatacttggaatacttttccccaccacctattttaagctagatttttggagggatatggtggggggtggtgatgtagttggatttatttaaacacacacatatataatgacaaaggaaataatagtatggctttttttctgtaaagtcaagcacttaccagtttttctctgctccttaattttatagagccagaatgaagaatggggaggtttgtctgaggatatcttatgataaagagcagtctaaggctttagtccctttgatccccaacttatttattggtaactactaaatttaccatttttgtggcatggataaaatggagtgctatgcaaatactgttgcacgtgagatgatttctaagtccttgcttgatccgtgaagatcaaatagttaaatactgggcatttgggctttaacccttagcggttgatgcatgatggtgttgattagtgctttgagatgtgtcaacctttcttttttatactaacagcatcattttgaaatttgtggtgttgtttttcttttgagctttgtttgctgttggtattttttctcactaaagtaatctgtgaaatgcaaaataagtgaggtaccaaaagcaagcataatactcatgaatttgcttttactttgagatgatccactttatgaatagatttactggatttgcagttgtttatctgcctcatctagaaagtggtactctacggaggattagcgctgctaaaattgatttgttttagtgctgggggctgcatgatatatcttagtactatgctatatttttgtgaaagtaataatctgtgggactgcatacaaatggaaaggtaagaatcttaggagaaaagtgatttcttttaaaaaatgaagcttttgtaacttaaaattattttaataagtactttttgaagtattgaataacatatcttttaatatgaagttttggactttttaaaggtcagctcttgatataattaagaatatttgggctgagcacggtggcccaagcttgtaatcccagcactttgggaggccggggcagttggattgcttgagcccagaagttcgagaccagcctgggcaatgtggtgaaaccccatccttacaaaaagtgaaaaaaaaaaagactagctgggcatggtggtgtgtgtctgtagtccaagctaattgggaggctgaggtgagaggattgattgagccctggaggtccaggctatagtgagccatgatcatgctactatataccagcctgggtggccacagaacgaaactttgccgaaaggaaggaaggaaggagggagggagggagggaaaacagaaaaaagaaagaatatttgggcatgctagtccaacttgagaatatcttaaattgttttaaaaaaagagatgcttccaaatatgtacaagaatgtcatttaacagcaaaaagcattttgatataaatcctcttagatttgcttaaataagacaaactcgtgtaactcctttgtaattactactgttcatgttaaaaccttcaagcctcttttaaagttaacaagactatagtcttttattgccagcgtactttagtttttttataggtaaacttaatcagggtttattataacaaattctggacaaatgaagtttgattacattaatgcttgaaatggaagtgcttgaaaggaagggcagaaagcaggacaaatgttgcctttcattttacatttaataagaaacaatttggccaggcatggtggctcacgcctgtaatcccagcactttggaaggctgaggcaagcggatcacttgaggccaggagttcaagaccaacctggccaacatggtaaaaccccatctctacaaaaaatacaaaaattagctgggcgtggtggtgcacacctgtagtcccagatacctggggggctgaggcacaagaatggcttgaacccaggaagcggaggctgcagtgatccgaaatcaggccactgcactccagcctgggcgacagagtgagactctgtctcaaaaataaataaataaataaaataataatttggccagtgtccttactctctggttctcaggttgtagtcattttgctttatgtgtttttgagccttttttcttttcatacttttcaaaattttgaggattttccgcttgctatttctattctattcttttcttaaatgctgatcctgacctagtaatttgatttcatgagccctagggttggaacctgcacagggacctgcaaagggaatagtctgtggtgtcggtggtgattttttttttaattaaaaaatactttctgaaaaatgtcacgtttgagtccttttttcacctactgacattttcttttgtttcctctgagggcctttttttaaaaataaaaattcccattctggaaaaattagcaaatacaggcaaacacactagaatataatcttacccaccaactagagccaattagattaactcagtggttcccatggagtgggagtggtgcagttgtgcccctctaggggacattgggtaatgtttggacacatttttggttgtcacaattgggggtgcagtgctaccggcatccagtaggtgaagaccaaggatgctgctgagaattctgcagtgcacaggacagcccccttagaacgcggaattatctggcctcaaatgtcagttgtgcccaggttaagaagccttggtttaatttaacactatggagtaaagattccatttacatttatagactgctatatcttttcaatattatatgtagaccacagtataaataagtggctaaaaattaatcaaaaatgcaaaaaatcaagaaaggataaatgtgcttaagaacatacaaatagctataaaaatcattcctaggccaggcgcggtggctcacgcctgtaatcccagcactttgggaggccgaggtgggtggatcacaaggtcaggagatcgagaccaacctggacaacatggtgaaaccctgtctctactaaaaatacaaaaattagctgggcgtggtggtgcgtgcctgtaatcccagctacttgggaggctgaggcaggagaatcgcttgaaccagggagtcggaggttgcagtgaagcgagataacgccactgcactctagcctggcgacagagtaagactccgtctcaaaaaaaaaaaaaaaaaaaagtcatctctatgattcaccaaaattacctctacataatgaccagttactggggagataatctatggttgactttagaatccaccctacagcaaggcttgtaggatgtcactctataatttaatttcctcaacaacagccaaatctgttaacttctattaaggtaattgagtttttatgtggaaactgaattgagtataccctgcagacagaacacctttgaattttctgccaatctccccagccactttagggatttgttaatttcttaaaggaggaatagttcaaatgaccagaatttacatatatagacttttgttgcatatatagactttttgttgttgttgttctctggcatcctgttagccttaaaggttttacttagtgaagatatttagtagcatttgagtatttgaaattctgtgattccaagaaatcttttacctttgaaaaaccctaatttagggtattccaaggcaaatacaatacagcatgtcctaaaacatgcttaaaatatttctttgcagtctaaaattatatttgctagctgggcacagtggcacacttccataatcccggctacttggaaggctgaagtggaaggatcccttgagctcagaagtttgagaccagcctgggcaacatagtgagacccctcactcttaaacaaattatatttgctaagttaattattctgcttttttttgtttgtatatttgttttgagacagggtctcactctgtcaccaaggctggaatgcagtggcaccaccatggctcacttgcagccttgaactcctgggctcaagtgatcctcccacctcagcctcccgagtagctgggattacaggtgcacaccaccatgcccagctaattttttaaaaattttcagtagaaatggggtctcgccatgttgtcagggctggtcttgaactccgaggctcatgcagtcctcccaccttggcctcccaaagtgctgggattacaggcgtgagccactgcacctggcctctgcttttttattttaaaagcacaactaactggtagataaagtgatttgtctttagtatttgataactaatgggttttagagtgttatttataagatgtagtaaattatcctcatcattatttttaagacaaatttataagacaagtgtaatagaaatagatcaacagcacaatagaaaaagatggcagaaaacatgaatatgtaattcacagatgaaagcaaaacaaatggtccttttattaagggaatgcaaagttaaaaatcaactagacccttttttgtttgtttcttcttggattggcaaagaggagcacttaaaagctgtattttgttttggaggattagtttggttatgtctactaatgactaaatgtgtacatacattttgacccattagttacacttcaaagaattttatccaacaaaaatgtactgagacacattgcttagtataataagccattgaagcttacccaaatattcatcaatgagaaataggttaagaaaattatagtacaaccatacatgaaactgatgtagctgtaaaagaaatgagatcgatttttttttgtaatgatatggaaggatactcaaagtatatcaagtgagaaaagatctaggaacaggatattattattattattattttattttttgtagggacagggtctcaccatgttgcccaggcttaggagcaggatattagctaactcgtgttacttctgaaaatctttgaagctccccctgctcttttttccagaagtgtaaaaacaagcatgtatttagtattacacatttttaaaaaatgaaaaaatgctgctgtgtgaatgaaagagtatacatcgtgttgctccagatggtaaaactagagtagaatttactaaaataaagtttcagcacgtaaagtaaagcacttctctgctcttggccattttagacactaaccatctggagcaaccatgtaactcttgccactcatagctaacttaatgtaaaaaaaaaaaatcgcttgactttcttagcacttcacaaatgcttgtaagactgacaccaggagccctgtcatctaaaaggcactttatagagtgctttcaattcttctgttttttcattcattgctcaaaatagatcgtagtgagataagatagtctctggccttcttggtctttggcacaaggaagagggttccagagttgagagtaaggactttgcatcctttgccatagaatttgattaggggccataaaaaggaccattgtgttctagaatgtgaaggactaagcataccactttatagtgcaaggaataagtgaagaagtccttttataagaaaaactgcagtagagcaataacttgaaattacacttatttatatttacttttcattaaatgtaaattattttcttttaccacattgtactactagaaagagaatcaggagtttaggcattcagtcatagatattcgataccattgatttacttaagcacttctcatgtcaacaagacttaagcctgcagataattcctattttatcagtgttcgttatagcttccctgttggttttacttgtgagtcataagcctagtatggtgaatatctaggaaatttcacggtaacagggcttgtcttaggttttgagaacaggtgtaacttgacttctctctgctgtttgtcatcctacacttcccactacatctggtcctttttgtagggtgttgagaacaacatttttcttcatgcaggggaaagtggaagtgcatgttttctaagaaggacaaataggaatagaataaaagaaaaagtatattggggctgggcatagtggttcactatgtaatcccagcactttgggaggctgaggcgggtggatcatgaggtcaggagttcgagaccagcctggccaagatggtgaaaccccatctctactaaaaaaaaaaaaaaaatacaaaaattagccgggcacagtggtgggtgcctgtaatcccagctactcaggaagctgaggcaggagaatcgcttgaacccgtgaggtggagattgcagtgagctgagatcaagccactgccttctagcctgggcgacagagcaagactctgtctcaaaaaaaaaaaattatatatatatatatatatatatatatatatatatatatattttggaagggagaatgggagtggaatcaaaaacattggtctcggatgagaagagtctttctcattggttatgtggtgataatggggtaaagctgtagactttttttttctttaattcatgagtaagatgagcaaaattgaggaagtgtcattttcttggccttgagaaatgacatcatctaaaggagaatcgttgggactggggagaaggggaggggtgtatagcttgaggacagtgtgaggagttggcagtagacttggtggggagcaaattagtgaggagcaaaaaagatttcctgggattgaaagcccgtttcaggttgaaataatacattgtcatccttattcaaagaataggtctccagagaacctgtactaaggacaatacatggtttatagttgtacaatacaactggattaaaaaattttttctcactgttttcattctgacctttattcccacttaattgaaatcactggggttttagtgttttaagaaacggatagtttgctgagtattatatgtgactatttcctacgggtgcccaggggaagaacaagatagtaggcctaggcctgcacagggtcccttgtgtgctatgacagactttactctcaccctccctaattcctaattgatataatttttatgtgactcacaagaggtactggtggtaagaggtataaactggaatttataattgaatctactttctttgtatctgaaagaaaaatattttggttaattatgggcatataatttagctaaaaaattaccttaaatgttaagtggtccttaaggcatttataacagaactttttcagaccctagaagtctaaactgggaaattatttaaaacgttattaaagcaatttaaaatggtaaaaataatacatttatttttgtgcattttagagtttcttttcttcttgaaggatgtttttccagtgaagaggggtttctccctatgaagagtattctcacatttaatagatggtaatttcttacttaagtacagtaatatggatcaatggctataaagaatagtttggcttatcatcaacccttttctttcctaaaagcagtaaaaggtgtgtcagggtataagtggtggaaatgcctgggtggtcacattgagaattgttcctgtagaattgctggtgtagttcatagtaagtctcctggggaggaatggttgcatactccgccctgtttgggaaaccacctcttctcttttaatgagcgtaagctctcgatggttggtttttacatggtatgatagaaaattaagagagaaaagaaaaagatgataaactataatataaaggctcaaagaactggtattatttaggcaaaaggttatttgacagattggtattatttaggcaaaaggttatttgacagacttaaacttttcttgttctctctccagaaaacagagactatgtatcacagcaagagtttcattgggtttaagaaagcgtactagaatacgtgctggagtactgacatgcatcaaaatgtagtaggatatataaattcagtttgtaatgacaattttgtcaagtttgttatttatattttagcattacctgaaaagtctaattacattaaatcccaagggatagtcccaattacttcattaaactggtattttcatagggaattttgcttggataatgatccattattggggcttataatttattttttacacagaatatggaaatagcttcagaggttcattgacaataaagcattcattaaatactgtgaatcactaatgccattgatacagaagaatttccctatgaaaatgagagcttctgtgagaaaatgaagtagttgggagtttaatttcttattaatatgattttaacttgctgcttcattccactatattctgagttgggggaaaagggcagctatctctttaaaatatttaggaattctttgaggattaaaatgtaactggcttttgtcctcagatacgtttgtaattaatggttgtgtaagtttagggatttgttagatatttttcttggaacagtttacatgattttgtagttcaacatttcaaagtttcaacttgaataaatattaaaatgaggatactttaaagacactcaaataagcaattttaaacttgctttctggtggggatataatccctttgagagtctgaaggatgatgggctgtcaccccaggaaaatttgcacatcattttgtttctaatttcagggaactctcagagcccctagaagtccttctgtagacactcaaatctggagagttcgttaaaatctgtcttgaggatttttaaaaaagtaatatcctcagtctcagtcaaattctttggattttttgcttttgtaggtataagtaaacggttaaaaaccttcattgctacttaaaataccagatgagtgactacttttccagtttttattgggaaagatttttctctaggttctttagtttatgtaatacaaatgaactaatgaatttaaatactggtggaaggggaatattctaattgaatttttggtcaactcagtattgaccagatgacttacactgaaaatcttttcataatattagtagtaaatatagtgttttaggattttgtaaaatttctggaggatgtctgtcatcattttgaacactgtatgtagtaaagttagaaaaaaatgaatctaaagtcttgggcattgtttagaagttaaatattcagccttaaaccaaagaatgaaagcaaacagaaacttaagttttagttatctttactgtgagctaaatgttctagaaatctgattgtgtctgtgtcagtttgtatactgtgtgtaagaatatatgcatttcttttgtagccacgtcatgaatattttaatgtccctgtgtactaaatgactactcatcgagtatgcagaatttcacagaggaaatagaatgctgatatacatatgaaagaaaatatcctcagcatggtgatttattgtcttgtataataatagtagaacattttagaactagtacttttatgattgtatttttttcctgttcacattccaaacttttctgttttattttcattctatatgtgatcttgatacagctcattcctttctgcaactgatttaatctcatcttgacaaaatatgacctagaagtgttttgagtaatattaaatcttaaacacatacatattattaatgaaccatctgtgatttatcttataagaggaaaacatgacaatcattaaaatgtttaccaaagaaaatatagctgaagtgctaggtcaaaataagcagtgccataatatatagtgtagtttggtcttcaaatatggaggttaaaaaaagaaactattttgtgtgattatcttacaatctgtatgagctaatgtgttctaatgtatcacataaaagtatatgtgaaaatattacaagaaactaaaattaatttgtaccattatataatatttaaggttaaaacattcagtattaagaaattttgtagtgccacatttattgaatcacatttgtgctatataataatatcaaacaatccctttaagaacttattagagagctatgtctgaagtctgttctgcaatatctgttgctgaataataactctttcaaagcattaatgctgagtttatatagttcaaaaattctaatattcattcagttttaatacctaaatacttatattttactagtgatggcattctaatatattaagtcctcatttaaatacttgatactttgttaactgtggcattatatttctgaattttaaaacctttaatattggtaactattgcatattcttttaataaaacatgcagcatatttttttataaaaggaaaagaattcattgtttatatctagagagcataaagcctaagttaagtaagttattaaacaataacttcacaagatgttcaaatcgatttatcactgaaagaagatctatgaaaatgtgttttgaccaaacttagtattaggcaggtacacagataagattttccattcttaacattctcactgtaatgcacgacatttgaagcacctggatgtgctatcaatcaggtgggaaatttagcattatatattggaagcattgagaaacattggtctttcatttctatttttttttcccctcctttcctcctcctgccccacaatatattattcatctggttttaatgctacataaatatgcattgtctcatgcctgtttgtgttggatgccttgtgctaagctgtaacaaaatgttgcttcttttgctgtctgtatacagctgcttgctttaaattagtagattctgaaatagctttccttgcatgtctaaaataaaagtattgcatgt

SEQ ID NO: 5506 - DNA, 23611 bp, human
atgccagccgggtgtcctccccacagcaccacggcttctcttcctcagcacggcgacaggggcttccccttcgccgccgccgccgccgccggccaagctccgccgcgcccgcggcccgcggccgccgtaagtccctgggggcgaaagggggcgccggggatgggggagagggggagggaggactgggcgcgccccccgccaccccgcgcgcgccccgacgaccccaccccgagcctgcccggcccgccactgggtcgccgcgcccgcaactcacttctctccgtgtccgcgccctccgcaccactccgcgccgcgcccggggatgtgggggccagtcccgggctccgcgacagcctcgcggcacctgtggttcgggaatcgcctcaagttttgcggggcgctttcgggaggggccgggggcggtggcggccgaggactcttggcgccccctgcgcggcggcggatgccattgtctgctccgctccttgcctgtcacctctcccgggcttggtcagtgatggagtgtggccacgggagtgggggggaggcaccggcgacggccggacccgaggaacgctggccccgagcccgcgccgcggctgagcccattgtttttaatgccagtctcgaggaattgtggtgccctgtgatttgcggcaaaatcaaagcgttggtttttaacacgagggaaggaatactcgtgctttgcaaccgggtttcgtcccatgttaggacataatttattttaaggagaatacattgttttttcgtcctgcaaagtggtagggcggatacaggaccctgctccagacagccttgagcccatactcttcgcaggcaaaccctcaccctttctggtcaccaagatctaggaatacgaggtccattcttttccaagttctggtaacgggtttgcagtaaatgcccagttgatgcttcacttcctgcccccttcgaatgccgctatcttcaggacttgcacgggaggcactttggtatcacctaataatgtccttatattttgttcccctgacgcattttaagtgaggtaataagaccattttaactttactaaagttgaattgccacgtcatacatttctagatatcttgttgatacctttttgggtggttacaaaaagcgacgataatttcttaccgaaatttagggcccatttttattctacattggttctgtaaatttcccctccccgtgttcaaattcaagatggtgtggtgaatcttgagaatcatgcttgaatcttatttgcagtaacgctgttaaaggaacttaacagtgattaaaagaaaaaaggatacctatgtgaattctgcctttaaattacctttgtagaaacaatacttctgtttgcagttgagatgaccaattggattacaaaaagcttggcgttaaaaatgaaacatgcagactaatcaacacatttgcagatcacaaataaatacatacaaattagtttaagtataaaacacactagaattcagcatccattccatctgtagatactattttttattttaaatgaagtatttcatgtaatgtttcaatgctgaatcttatttaataagtgtaaatcttattgtggccttttaaacgtttgttttctttttcataatacattaactcagttctagattttgtacatatttaagttggaatgctttaaaagtcagatgaaaacatacttttttattaatgaaaatttgtatttatgggatttttcagttaatattttggatcattctgttttgcttaaaatatgccatcataaactgaggagaacattccaagacataagctactgtctgcaagtaattcaccctggaactagaacggcctcaggatgaaaaatagcaggtcttctgtttctttcaaaagtacccaaaccagatgatgtctaccattctcttttgatgcatatagagagtgcgcaatgtatagcacaggtagaaaatagtttcttaaattgaaagagtgatctttatttttcttcaaaaatttcacttcagcttattacccatttttcttttttctcctgcacactccccttcaaacttaatgtggaacaaggtgggattggaaggtttgcatctagaggaagatctgtccaaaagaatttcttgctattttaattggcatagaaatattgatggctactaatcatttgtcatgtaaatgccccatcccccaaaacttctctgtgaaacacataatcttaactttattgattcaaagtattacatgtaatcttgattttatttatcttaacagatgcagtttatgttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaaggtataatttttgtttgtcagaaaggtgaaatagaatcaaatgttaggtcatttaggaaattgcagacttcagtgatgacatttataaataacgattaataaagatttagatgaaataggtttaaggtaaagctttgtgtttttaaaataactagtgttttgattgataattactgaggctgaaatgataaaggcagggaaatcctttgaaaactagttatataattaaaggcataaatgattattcatgcttaatcatctttatagaagagtttaatgaattcatttcattgcaggggaaagtagggtcagtattttaaattgtgtgagtaattctctgaattgagacaagtacagatagagtctaattctttttccccgaaaatctataaagtaatgactaatatttgacatgccttttatctgatttttagaatcttactcacgtgtaaataccttgactatgtagactatttcaatcacatagatgttttaaaaactttgtgtatacatgagatgtgtttgtaagtagtgtttattaacttttaagtacccttgttgctatggtgggggtgcaattaaatatgacagataatttttccaaggacagattttttaaaaatttgatgttacaaaatgactcatagattggcttttaacactaaaatttttttaatgctatacgtctttattttataaatatctgaaaccctgaataccctaaaataaatttctcaagattgttctaagtaggttaaaagaaataaactttcttcttttacagaacattttttgaggggacatttacttcattccccatttgtttctttttgaataatttgctgaatttaagataagagcatttctgcatataaaaagttctcttgtgtggggagtatacatggaagtaacagtatgggatacaatgagggtgggagagaagtctggttttcttctcagcttccctttattgcactccaaatatgggttggatattttgtcagggagatggctgggaagaaatggagattacaagacataagtttcttaaatactgaggactcctctttattattgaatgatctttggtgattttgtatctttgggtgattttgtatccagtgtttcgtttggtcttattaaagattatagaaaagtcatatcatttgagaggtgagagatgttttacagtgatctagtcaggtgattttgttttgttttgttttgttttaagctttttgccccatgggtagaaccttaaataaaatgagtggaagtgaggctgctccttgtgaaatcaggaatgaggatcctgtatcctggctcacttggcctttacccctctgcacaggagacagttcttgagtttgaaaactgccgttgttgatcaaacttcaattttataaagaatgcaaatttgggagaagtgacttgtctagggccatatgccagttagtgattgacatggggctgcaactcagatcttaagcttagaggcaaagattttaaacagggctggaaaaagatcaggtttacatatcttaaaagattgaactgagacaatggatgagggcaggaggggctgagactggcacctgcaggatcagtaggagactatgtgagatcctgaacccaggcgctagaaaggagggctgtcactaaatagccattatcaaataggtaggtttgataagacttggtcacctctagaagtgggaagaatatgggaggtcgaggcaggagaatcgcttgagcccaggagttcaagtccagccctggcaacttagtgagaccccgccgtctctacaattaaaaaaaaaaaaaaaaattagctgggcgtggtggcatgcacctgtattcctagctgctctggaggctgaggtgggaggattgattgtgcctgggagttcaagcctgcactgagccctgattgggccactgcactccagcctaggtgacagagtgagaccctcaacgacaacaacaaagcggagagagcagcgaaggaaagggaggagtggggtgatctccacatttctggtttgctgatggggtacaaggtgagctagataactcggcttattttggggtgagttgatttggggatgtctatgtgactttcattaagagaagcctgattttctggtgggatgtggttggtgtaagtatggaagtctggggaaaataagacaaagtattagatcaccagcattcaagtggcaggcaaaggagatgaagaagggaccttcagagtggaatgagaaatttcaccaatgccagatgttgcataaagttcaatgaaagtgaggaaggaatctggtagattttacagtgagcatttcatataatgccctttgccagaacattttcagtggaatagtggagatagaactctcgatgtaatggggcgaagtgtgaagaggtggagaaatttaaatagcatgtgtagactattttggggaactttgctgtgaaggacaggagacgaggtggtaaccactcatagacataggagtgggggacaaggtttttaaaaaagaaggtgtgagaggcttaagcttatttctagataggggaaggagtcccccgtgtggaggaggaaaataccagcaagggattcaatcccaggaatgggctgttatgggaagaaaggaaagcactgcttggtgttcatgcacatgtcactcagtctgtccgtgttgagccactactttttcttttgaaagctacaaagggtatctaatccaactctgatacttatatcaagcacctttaaataaaaggtggactttaaaaaaaacagctttattgagatatcagtcatatacaaaaggtggaatttatcagttctttctctatacgttcccccttccatttcatactgaaaacctcatctactctaccacttacggacatattttttgttggtataaacaggtggtttgttttccctactgctggaagcgaagagctttttaagcaggagaattactgcttagcgcctgagaaattctggactgggacttctgctgttcatatcagcaagtgatttttgttgtttttgttaaattatctcatctacattcttcatcctgagtatttggcatacaaattcccccttttgagaggggaatgatggataagaataatattagctgaaaagacagactgaaaatctggggacttaagttctgttccctttgtaacgttagctagttttatgactttaaacaagtcactttgtttccttatctctaaatgctcttgaagatcccttcaagacagaatactgtgcttttttgattcctgttttgtgtagcattttgtggaagagtcactggattaaggtcttttaaaattaatttaaaaacatatatatctccaaattactagcttgataatttgttaaagaatacttactgattttctttactaacaaaagaatttttaatgacataccagtgggtattgagaacacttcagctacattcacccacagtcagctgatatttagctgatatttagctgactgcggagaagtcatgtgttttgaatataagaataggcactttcagatgttctctgagtgccagtaattagagtaagccttaatccactgtgctaaaaataaccaaacatacctttcttcttactagtctattattaattttacttcagatttagacttacaaataggcactaagagaacaaaatgagctcattattgatttttttaaaaccatttggtcctaaatataggaagtacacttcaggttctcttggtaatcttttactaaatcagtatggcatattttacttctcttcaaagctcttaaaatattgtttcgagcacattttaatttttgccaggtatgggattacgttaatgcaattgctggctatagtttttaatgtaaaacttgggctctagagtcaaattgctgttcctaggcaggttactcaaacctgggtctcttatcaatgcaaataataatggtatctcatggatacggttgttgtgaggattagagtggtaaaatatgcaaaagccttagctaacatttaatgtctcatgtagggcgaggattcagtgaatggtacttaattattatgtttctgtttttttcctgccctaagctttctggaaagaggtacattattatcctgatagctatctgttcacctacaccaaagaattcattaatttgattattctttttccattccgagtgaaagtaaacattactggctggggcttagacacattgtttctgatgatttttaaattaatgcttccaagtgattcatgcagtttaggacctttgactagtgtttaagtgctttttatttgtaagtaaagaggcagtactgtggataaggagcgaggatggtacgagcattagcttgtttaatagtagcatgaggaaatcttaaataaaaggaattttacttgaaactgttagtaaactttgtataataaattatttagcattctgttcctatcagctagtcatatctggtttttaatctaccatttttatgtcagtccctttaatgtttagttttcttaaatcagggaatcttatgtgtcatttatcagtttcctcaaattcaaagttctatttaatgagcatgggttagggaggatggagagttggaatactctattctcttttaaatagacaaacaaaaacagtaacgatgggaaagagagggagcactttgttaaagttggcattgatgccctgttttgtcttccatgacttattcccttcacaatgatgataaatgaacacatgtgaatacctcctctcaataagactgcagtagctccaccattttaaataacttactgagtgtggaagtcaggtagagtagacatgcacaaactcatgatatatatgccaagtgagtttgtatgatacagtggaaaaaggcctggagttaaggtcaaaagatcaggtttcttatcccagtactagcacttgtaggcgctgtactcttaagcctcattttttttttgtctttttttaatctgtgatcaaggatgaaagatagtacttgctgttgaaaacatcaaataagatgaaatggttttaataatgaaattaatgctgttgtgtgaatactagttattttcatactaaggagcaagaattcattgagtctcaaaacaggttgtgttattctgtatacagtattattttacattaatgctacgagcagtaactgcccattgtgttttctaaaaatcatttaagtgatcttcagtgaaaattataatctccactgaaatgttctgtgtttagcctatcttaggtttttattttctttcttttcaaaagccttaagtacatgtaaaccattttaaaatgcccttttaatcctcctcaaaggacttgctatgcctcagggttgaagttttgcttccttgggtcaagcataacatgattccatatgctagaatcctaatttgaaggagaatataagtttcccaaccttattccctcttctagggtaaataaactacacttcagttcaacagtgtagaacttggtaaatttgagaacaggcctctgtttcccttaagtgataggaactttctgttctctttctctaacttctgtaataacgtggagctgttgttcttttcgtatggtttattctgcaatcctagaaacctttttaaaaacaattctattctgttagaagtcaagagcatagttacccttgggggtgggaggttgtgactgggagagggtagcagaggagtttcagggttcagtagtgttcagcttcttgatgtgggtgctgatatatagttgagttcactttgaaaatttattgagcttgtaggacttaaggtcttctctgtgtatatattatacatattccaataaaatatcccaaaatattgacctcaccttggcattatcctcaacaagtcctccttcagttggaaggtttgttttcttctctgtacttacagtttgaattaatctgctatatattttgttttaattaagtaaacttaggaaaaacctgggtctgctatgttttaaaatgcttatagaaaagaacctgaaaggaagaagggcaaaatcacttattctaagtggtatgattattttgattttttctttatacttgcctatgcttttcaaaatttctgttatgcgtttattacttttgtagtctatgagaaaaatctgtactgtcgtgaaagaagaaataaactgtataaacttggggcttttcataataggatatgaaaatatatttagaaaacatcattataggataacagtttttttcacatttgtactttgttacagatatgctagtctgtatttttgctgtgctattgaggatcaggacaatgaactaattaccctggaaataattcatcgttatgtggaattacttgacaagtatttcggcagtgtgagtagtattttattttaggaaattgaatgccatagtatattttggaaccttttctctaacaagtttattttttggttgtcttggggattctaaccgcgggagagggtgggaatgactatttattagtagaaattattaagttgtccatattgggaacatgcagagcccagtcttatttagcttgtaggaatatgttttcaagtacttgagatttggaaattaagcttacttaaaccagtgatacttagtcatttttagaaagagttaagattgattcactctagttcgattttattcactacctgatagtgaataagcatcttctgcttctgcaagttttaacaattttttcttttcttttttcttttttttttccttttcaggtctgtgaactagatatcatctttaattttgagaaggcttattttattttggatgagtttcttttgggaggggaagttcaggaaacatccaagaaaaatgtccttaaagcaattgagcaggctgatctactgcaggaggtaagctacttattctcttcactaggcactagcatgttttgctcttgctggggaagtctcattcatcattcttacagtttcagaaagtactctgaagcatgcttgtcatgtagtgtccatccatgtgcagtttattgactggaatatgtgtcagtcacgtcaactcagttatctatggatggatggttcagtttggagatggtctatcggtcaggcctcttcccaatggccctttttggaccctaaaacactggagtctaaacctttagaggacagactatttgaagaagggaaaagattggctgaaagtagcagtaagttgagaactctccatctattgcttcaaattgtttaagataaccccctttttcattagtgtagataatcaggagttgactatgagattatgacattttaattccaaattggctcatatttttacctcatgtccattaaatgcaaaagtagccaagcaaatgatagtgttttctaattatactttttgtagaaacttccaggttttttttgttagcaaaactaaacagtatttgcatttctctttgctcttcttaaataacaaaccatgttctgtcaaactgcattcttgtcttacctccatatccccagatgtgtaactcccttttctttctaattaccatagtcatcttgggttaattgtgcagttgatgctgatgtaccttctatttctgaagcttaacatttcatagataaggctacctttttccaaaaacttaatgataccttaattcagataccaaattgaattatgctttagagctaattgtgatttttatcatatggaaagcttacagcatgagaagtgattagtaaatattgaaaaatgaaatgtgttttcactaaagtagttgttaagtgtgtgtttgcatgtatgtaaaagtcttgaatatttttggctcactggttcattttccagaagcattgaaaatatgattttgtatttccagtttattttagtcccttctttgttacatacatgtttatcagtttgttcttgtctttttttagtcaccaaaggtgactttcagtcccattttttagccttggaggcattcagttttaagggagtgaaataaggggagaagagtaacttactttctccattttaacttcttaactcttggactctgtgaggaagggaaagctgtttgagaatctcactgcatcagtcactgactgggacagttgtggggattgcttgaagttgagatgacatcatctggatagacatctactaaatgtgagacaatgcattgtacacttaatgatcttgtagttatcagaagagtggttaaggtgcctgcaaaagtgaagtattagattggcagccctggtgccatctactcttcagtagtgaaatgaacacagaccttttgccttgtgtgtacagtttgccacagtggtttaccaattgattggaaatgttattctggaggtttgtttttaatatcaggtgcgctgactataagcatatactctactgttgtaaaattggtttttaaagttagtatctccttattttgctgttcactaatcagacttttttaaaaattaggtcaaaaccaggattagaaattgggaatttttcatataggtcttcccttgatcactttcatattttgtcacagatctgtattctgctctgtcagaacctggcatttcttccaagtttttctatcattttctgattaattacattggctttaaaatgtatttaaagttattgaagttcaacttttaattttaatatttttcctggagagtaattttttgtttgtttgtttgagatggagtttcgctcttgttgcccaggctggagtgcaatgacacgatcttggctcactgcaacctctgcctcccgggctcaagcgattctcctgcctcagcctcccgagtagctgggattacaggcttgcactaccatgcctggctagttttgtacttttagtagagacagggtttcaccatgttggtcaggctggtctcgaactcctgacctcaaatgatccgtcccccttggcctcccaaagtgctgggattaaaggtgtaagccactgcacccagctgtgcctggatttttaaatgctactgggaaattgctatgggccttagaatatgacagcaatgttaagtttaccttagagcatatattcagtatttaatgtactaggggataagaacattattgcagatccacatttatttgtgtgtgtatatgtacatatgtatatatattcccctatgggagtattttaatagttaatattgtccttctgtttgaagtactatttttatgtctttttttttttttttttgagatggagtttcgcttatcacccaggctggagtgcagtggtgcaatttcggctctctgcaacctccgcttcctgtgttcaagcaatcctcctgcctcagcctcccaagtagctgggactacaggtgcacaccaccatgcccagctaatttttgtatttttagtaaagacaggctttcaccatgttggccaggatggtctcaaactcctgacaggtgatccacccacctcggcctcccaaagtgctgggattacaggcgtaagccaccgcatccagcctatttttatgtctttaattggggaaagtaagtgcaaagagaaaagcataggatgagtatggttggtcccatgtaaaattttccttacccccttgtaacctttgtttaaaataaagaaatgagtactgttaattacagttccttgtctttagaagaaagctgtggtcctgtttctcttctatgactacttttacattgctttgtacacaaacgaaactgagtaccacattgagacattgtctatttagcagtctgagtgaaccatttttcttagccatgtaggtcttggggaagcagtaggtggtggtccattctgaatttagagtgagaatacatcgtaggttaaggccattatgaagccaagctcaagtctgtgtggagcagtaaggcttcaggttattctgttctcttcatcaacatactctgagaagaaatgcaggaatggcaagatgcatgtttcctaaaaatagattcatttatatttttgatgcatgatacaagtttacatctgtgggagagtatttgaatattatgttcataaaatagcaagtggaataagagaaaaagcactccacaaactgctggaaaactttttgttttggataccatgacaacaaaaataattatgatggtaactaacgcttgagtgcttgtatgtgaggccctgggctcagcagtttgctttaagcatcctgtgctaatcctcaagacaccctgtgaaaggttagaggtagcctaatgagaaagtggaatctcagtgaggttccatgactggtctgaggccacctggttagcaactggcaaaaccaggattctaaacccagatctactaggcttcacagctgtgtaaaatcttaaccactgtgcacttcccctaaccccagttatgtattgtcttggtatatatattttaaacgttctgttttagatatgaacttctttgtttctcagtcatatagtgagaaattcataattctcccagaggtttttctgtgtggaaaagagtagatttcctaagacagtgccatctttgacttcttagactgcaaatttttattgtccagattatcagcagttggaattttttattggatatgtagatataaataatatttttcaacctatttcttgttggattgatcaaaatgcctggatttataataacttttttggtcttatagtttggggtatagcattcacttaatcaatttcatgaaatgattttgcttccaaaattgtaaatatagctgtgaagatctaaattcagacttacatttgtagtagaagtcctaattggtcaattttaatctactttttcatgtgtcattatttttctgtttagtgtcaggtcttttacttgaattgattatttctaagcaccaaagatgactttgaacttatcatgtacttatctgttggcttaaaggtgtatacacatctcaatgattttgatttttttttaatttgtgaaatatacatttctatccttaagaatgcttattttcttcagaaaaattaaaaaaaaatttctcttacccaatttgtataaacacatagtttaaggtagtccttcattttatagccaaatagggaagagggtcagtggatacagattttctgttagcatattacagttagtaataaaaatgtaacattaaatgtacattcaaataatagttgctaaaatattagcagatattgtgattagataataaagatatcttttttattttacttcattacttggtaaataaaggattagttttgacatttctagaccaaacttcatgtttattccttttggtgtttggttgtatgaatacataattagatttgggggtaaagcccagaaattggcccgttatccattttttaatgtttggctgtcttaacatgccactggtactaaagatgattcttaaattattaaagtacaacatgctgaaattgctaaattgatattctttgcaatacttggaatacttttccccaccacctattttaagctagatttttggagggatatggtggggggtggtgatgtagttggatttatttaaacacacacatatataatgacaaaggaaataatagtatggctttttttctgtaaagtcaagcacttaccagtttttctctgctccttaattttatagagccagaatgaagaatggggaggtttgtctgaggatatcttatgataaagagcagtctaaggctttagtccctttgatccccaacttatttattggtaactactaaatttaccatttttgtggcatggataaaatggagtgctatgcaaatactgttgcacgtgagatgatttctaagtccttgcttgatccgtgaagatcaaatagttaaatactgggcatttgggctttaacccttagcggttgatgcatgatggtgttgattagtgctttgagatgtgtcaacctttcttttttatactaacagcatcattttgaaatttgtggtgttgtttttcttttgagctttgtttgctgttggtattttttctcactaaagtaatctgtgaaatgcaaaataagtgaggtaccaaaagcaagcataatactcatgaatttgcttttactttgagatgatccactttatgaatagatttactggatttgcagttgtttatctgcctcatctagaaagtggtactctacggaggattagcgctgctaaaattgatttgttttagtgctgggggctgcatgatatatcttagtactatgctatatttttgtgaaagtaataatctgtgggactgcatacaaatggaaaggtaagaatcttaggagaaaagtgatttcttttaaaaaatgaagcttttgtaacttaaaattattttaataagtactttttgaagtattgaataacatatcttttaatatgaagttttggactttttaaaggtcagctcttgatataattaagaatatttgggctgagcacggtggcccaagcttgtaatcccagcactttgggaggccggggcagttggattgcttgagcccagaagttcgagaccagcctgggcaatgtggtgaaaccccatccttacaaaaagtgaaaaaaaaaaagactagctgggcatggtggtgtgtgtctgtagtccaagctaattgggaggctgaggtgagaggattgattgagccctggaggtccaggctatagtgagccatgatcatgctactatataccagcctgggtggccacagaacgaaactttgccgaaaggaaggaaggaaggagggagggagggagggaaaacagaaaaaagaaagaatatttgggcatgctagtccaacttgagaatatcttaaattgttttaaaaaaagagatgcttccaaatatgtacaagaatgtcatttaacagcaaaaagcattttgatataaatcctcttagatttgcttaaataagacaaactcgtgtaactcctttgtaattactactgttcatgttaaaaccttcaagcctcttttaaagttaacaagactatagtcttttattgccagcgtactttagtttttttataggtaaacttaatcagggtttattataacaaattctggacaaatgaagtttgattacattaatgcttgaaatggaagtgcttgaaaggaagggcagaaagcaggacaaatgttgcctttcattttacatttaataagaaacaatttggccaggcatggtggctcacgcctgtaatcccagcactttggaaggctgaggcaagcggatcacttgaggccaggagttcaagaccaacctggccaacatggtaaaaccccatctctacaaaaaatacaaaaattagctgggcgtggtggtgcacacctgtagtcccagatacctggggggctgaggcacaagaatggcttgaacccaggaagcggaggctgcagtgatccgaaatcaggccactgcactccagcctgggcgacagagtgagactctgtctcaaaaataaataaataaataaaataataatttggccagtgtccttactctctggttctcaggttgtagtcattttgctttatgtgtttttgagccttttttcttttcatacttttcaaaattttgaggattttccgcttgctatttctattctattcttttcttaaatgctgatcctgacctagtaatttgatttcatgagccctagggttggaacctgcacagggacctgcaaagggaatagtctgtggtgtcggtggtgattttttttttaattaaaaaatactttctgaaaaatgtcacgtttgagtccttttttcacctactgacattttcttttgtttcctctgagggcctttttttaaaaataaaaattcccattctggaaaaattagcaaatacaggcaaacacactagaatataatcttacccaccaactagagccaattagattaactcagtggttcccatggagtgggagtggtgcagttgtgcccctctaggggacattgggtaatgtttggacacatttttggttgtcacaattgggggtgcagtgctaccggcatccagtaggtgaagaccaaggatgctgctgagaattctgcagtgcacaggacagcccccttagaacgcggaattatctggcctcaaatgtcagttgtgcccaggttaagaagccttggtttaatttaacactatggagtaaagattccatttacatttatagactgctatatcttttcaatattatatgtagaccacagtataaataagtggctaaaaattaatcaaaaatgcaaaaaatcaagaaaggataaatgtgcttaagaacatacaaatagctataaaaatcattcctaggccaggcgcggtggctcacgcctgtaatcccagcactttgggaggccgaggtgggtggatcacaaggtcaggagatcgagaccaacctggacaacatggtgaaaccctgtctctactaaaaatacaaaaattagctgggcgtggtggtgcgtgcctgtaatcccagctacttgggaggctgaggcaggagaatcgcttgaaccagggagtcggaggttgcagtgaagcgagataacgccactgcactctagcctggcgacagagtaagactccgtctcaaaaaaaaaaaaaaaaaaaagtcatctctatgattcaccaaaattacctctacataatgaccagttactggggagataatctatggttgactttagaatccaccctacagcaaggcttgtaggatgtcactctataatttaatttcctcaacaacagccaaatctgttaacttctattaaggtaattgagtttttatgtggaaactgaattgagtataccctgcagacagaacacctttgaattttctgccaatctccccagccactttagggatttgttaatttcttaaaggaggaatagttcaaatgaccagaatttacatatatagacttttgttgcatatatagactttttgttgttgttgttctctggcatcctgttagccttaaaggttttacttagtgaagatatttagtagcatttgagtatttgaaattctgtgattccaagaaatcttttacctttgaaaaaccctaatttagggtattccaaggcaaatacaatacagcatgtcctaaaacatgcttaaaatatttctttgcagtctaaaattatatttgctagctgggcacagtggcacacttccataatcccggctacttggaaggctgaagtggaaggatcccttgagctcagaagtttgagaccagcctgggcaacatagtgagacccctcactcttaaacaaattatatttgctaagttaattattctgcttttttttgtttgtatatttgttttgagacagggtctcactctgtcaccaaggctggaatgcagtggcaccaccatggctcacttgcagccttgaactcctgggctcaagtgatcctcccacctcagcctcccgagtagctgggattacaggtgcacaccaccatgcccagctaattttttaaaaattttcagtagaaatggggtctcgccatgttgtcagggctggtcttgaactccgaggctcatgcagtcctcccaccttggcctcccaaagtgctgggattacaggcgtgagccactgcacctggcctctgcttttttattttaaaagcacaactaactggtagataaagtgatttgtctttagtatttgataactaatgggttttagagtgttatttataagatgtagtaaattatcctcatcattatttttaagacaaatttataagacaagtgtaatagaaatagatcaacagcacaatagaaaaagatggcagaaaacatgaatatgtaattcacagatgaaagcaaaacaaatggtccttttattaagggaatgcaaagttaaaaatcaactagacccttttttgtttgtttcttcttggattggcaaagaggagcacttaaaagctgtattttgttttggaggattagtttggttatgtctactaatgactaaatgtgtacatacattttgacccattagttacacttcaaagaattttatccaacaaaaatgtactgagacacattgcttagtataataagccattgaagcttacccaaatattcatcaatgagaaataggttaagaaaattatagtacaaccatacatgaaactgatgtagctgtaaaagaaatgagatcgatttttttttgtaatgatatggaaggatactcaaagtatatcaagtgagaaaagatctaggaacaggatattattattattattattttattttttgtagggacagggtctcaccatgttgcccaggcttaggagcaggatattagctaactcgtgttacttctgaaaatctttgaagctccccctgctcttttttccagaagtgtaaaaacaagcatgtatttagtattacacatttttaaaaaatgaaaaaatgctgctgtgtgaatgaaagagtatacatcgtgttgctccagatggtaaaactagagtagaatttactaaaataaagtttcagcacgtaaagtaaagcacttctctgctcttggccattttagacactaaccatctggagcaaccatgtaactcttgccactcatagctaacttaatgtaaaaaaaaaaaatcgcttgactttcttagcacttcacaaatgcttgtaagactgacaccaggagccctgtcatctaaaaggcactttatagagtgctttcaattcttctgttttttcattcattgctcaaaatagatcgtagtgagataagatagtctctggccttcttggtctttggcacaaggaagagggttccagagttgagagtaaggactttgcatcctttgccatagaatttgattaggggccataaaaaggaccattgtgttctagaatgtgaaggactaagcataccactttatagtgcaaggaataagtgaagaagtccttttataagaaaaactgcagtagagcaataacttgaaattacacttatttatatttacttttcattaaatgtaaattattttcttttaccacattgtactactagaaagagaatcaggagtttaggcattcagtcatagatattcgataccattgatttacttaagcacttctcatgtcaacaagacttaagcctgcagataattcctattttatcagtgttcgttatagcttccctgttggttttacttgtgagtcataagcctagtatggtgaatatctaggaaatttcacggtaacagggcttgtcttaggttttgagaacaggtgtaacttgacttctctctgctgtttgtcatcctacacttcccactacatctggtcctttttgtagggtgttgagaacaacatttttcttcatgcaggggaaagtggaagtgcatgttttctaagaaggacaaataggaatagaataaaagaaaaagtatattggggctgggcatagtggttcactatgtaatcccagcactttgggaggctgaggcgggtggatcatgaggtcaggagttcgagaccagcctggccaagatggtgaaaccccatctctactaaaaaaaaaaaaaaaatacaaaaattagccgggcacagtggtgggtgcctgtaatcccagctactcaggaagctgaggcaggagaatcgcttgaacccgtgaggtggagattgcagtgagctgagatcaagccactgccttctagcctgggcgacagagcaagactctgtctcaaaaaaaaaaaattatatatatatatatatatatatatatatatatatatatattttggaagggagaatgggagtggaatcaaaaacattggtctcggatgagaagagtctttctcattggttatgtggtgataatggggtaaagctgtagactttttttttctttaattcatgagtaagatgagcaaaattgaggaagtgtcattttcttggccttgagaaatgacatcatctaaaggagaatcgttgggactggggagaaggggaggggtgtatagcttgaggacagtgtgaggagttggcagtagacttggtggggagcaaattagtgaggagcaaaaaagatttcctgggattgaaagcccgtttcaggttgaaataatacattgtcatccttattcaaagaataggtctccagagaacctgtactaaggacaatacatggtttatagttgtacaatacaactggattaaaaaattttttctcactgttttcattctgacctttattcccacttaattgaaatcactggggttttagtgttttaagaaacggatagtttgctgagtattatatgtgactatttcctacgggtgcccaggggaagaacaagatagtaggcctaggcctgcacagggtcccttgtgtgctatgacagactttactctcaccctccctaattcctaattgatataatttttatgtgactcacaagaggtactggtggtaagaggtataaactggaatttataattgaatctactttctttgtatctgaaagaaaaatattttggttaattatgggcatataatttagctaaaaaattaccttaaatgttaagtggtccttaaggcatttataacagaactttttcagaccctagaagtctaaactgggaaattatttaaaacgttattaaagcaatttaaaatggtaaaaataatacatttatttttgtgcattttagagtttcttttcttcttgaaggatgtttttccagtgaagaggggtttctccctatgaagagtattctcacatttaatagatggtaatttcttacttaagtacagtaatatggatcaatggctataaagaatagtttggcttatcatcaacccttttctttcctaaaagcagtaaaaggtgtgtcagggtataagtggtggaaatgcctgggtggtcacattgagaattgttcctgtagaattgctggtgtagttcatagtaagtctcctggggaggaatggttgcatactccgccctgtttgggaaaccacctcttctcttttaatgagcgtaagctctcgatggttggtttttacatggtatgatagaaaattaagagagaaaagaaaaagatgataaactataatataaaggctcaaagaactggtattatttaggcaaaaggttatttgacagattggtattatttaggcaaaaggttatttgacagacttaaacttttcttgttctctctccagaaaacagagactatgtatcacagcaagagtttcattgggtttaagaaagcgtactagaatacgtgctggagtactgacatgcatcaaaatgtagtaggatatataaattcagtttgtaatgacaattttgtcaagtttgttatttatattttagcattacctgaaaagtctaattacattaaatcccaagggatagtcccaattacttcattaaactggtattttcatagggaattttgcttggataatgatccattattggggcttataatttattttttacacagaatatggaaatagcttcagaggttcattgacaataaagcattcattaaatactgtgaatcactaatgccattgatacagaagaatttccctatgaaaatgagagcttctgtgagaaaatgaagtagttgggagtttaatttcttattaatatgattttaacttgctgcttcattccactatattctgagttgggggaaaagggcagctatctctttaaaatatttaggaattctttgaggattaaaatgtaactggcttttgtcctcagatacgtttgtaattaatggttgtgtaagtttagggatttgttagatatttttcttggaacagtttacatgattttgtagttcaacatttcaaagtttcaacttgaataaatattaaaatgaggatactttaaagacactcaaataagcaattttaaacttgctttctggtggggatataatccctttgagagtctgaaggatgatgggctgtcaccccaggaaaatttgcacatcattttgtttctaatttcagggaactctcagagcccctagaagtccttctgtagacactcaaatctggagagttcgttaaaatctgtcttgaggatttttaaaaaagtaatatcctcagtctcagtcaaattctttggattttttgcttttgtaggtataagtaaacggttaaaaaccttcattgctacttaaaataccagatgagtgactacttttccagtttttattgggaaagatttttctctaggttctttagtttatgtaatacaaatgaactaatgaatttaaatactggtggaaggggaatattctaattgaatttttggtcaactcagtattgaccagatgacttacactgaaaatcttttcataatattagtagtaaatatagtgttttaggattttgtaaaatttctggaggatgtctgtcatcattttgaacactgtatgtagtaaagttagaaaaaaatgaatctaaagtcttgggcattgtttagaagttaaatattcagccttaaaccaaagaatgaaagcaaacagaaacttaagttttagttatctttactgtgagctaaatgttctagaaatctgattgtgtctgtgtcagtttgtatactgtgtgtaagaatatatgcatttcttttgtagccacgtcatgaatattttaatgtccctgtgtactaaatgactactcatcgagtatgcagaatttcacagaggaaatagaatgctgatatacatatgaaagaaaatatcctcagcatggtgatttattgtcttgtataataatagtagaacattttagaactagtacttttatgattgtatttttttcctgttcacattccaaacttttctgttttattttcattctatatgtgatcttgatacagctcattcctttctgcaactgatttaatctcatcttgacaaaatatgacctagaagtgttttgagtaatattaaatcttaaacacatacatattattaatgaaccatctgtgatttatctta

SEQ ID NO: 5507 - DNA, 21059 bp, human
gtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaaggtataatttttgtttgtcagaaaggtgaaatagaatcaaatgttaggtcatttaggaaattgcagacttcagtgatgacatttataaataacgattaataaagatttagatgaaataggtttaaggtaaagctttgtgtttttaaaataactagtgttttgattgataattactgaggctgaaatgataaaggcagggaaatcctttgaaaactagttatataattaaaggcataaatgattattcatgcttaatcatctttatagaagagtttaatgaattcatttcattgcaggggaaagtagggtcagtattttaaattgtgtgagtaattctctgaattgagacaagtacagatagagtctaattctttttccccgaaaatctataaagtaatgactaatatttgacatgccttttatctgatttttagaatcttactcacgtgtaaataccttgactatgtagactatttcaatcacatagatgttttaaaaactttgtgtatacatgagatgtgtttgtaagtagtgtttattaacttttaagtacccttgttgctatggtgggggtgcaattaaatatgacagataatttttccaaggacagattttttaaaaatttgatgttacaaaatgactcatagattggcttttaacactaaaatttttttaatgctatacgtctttattttataaatatctgaaaccctgaataccctaaaataaatttctcaagattgttctaagtaggttaaaagaaataaactttcttcttttacagaacattttttgaggggacatttacttcattccccatttgtttctttttgaataatttgctgaatttaagataagagcatttctgcatataaaaagttctcttgtgtggggagtatacatggaagtaacagtatgggatacaatgagggtgggagagaagtctggttttcttctcagcttccctttattgcactccaaatatgggttggatattttgtcagggagatggctgggaagaaatggagattacaagacataagtttcttaaatactgaggactcctctttattattgaatgatctttggtgattttgtatctttgggtgattttgtatccagtgtttcgtttggtcttattaaagattatagaaaagtcatatcatttgagaggtgagagatgttttacagtgatctagtcaggtgattttgttttgttttgttttgttttaagctttttgccccatgggtagaaccttaaataaaatgagtggaagtgaggctgctccttgtgaaatcaggaatgaggatcctgtatcctggctcacttggcctttacccctctgcacaggagacagttcttgagtttgaaaactgccgttgttgatcaaacttcaattttataaagaatgcaaatttgggagaagtgacttgtctagggccatatgccagttagtgattgacatggggctgcaactcagatcttaagcttagaggcaaagattttaaacagggctggaaaaagatcaggtttacatatcttaaaagattgaactgagacaatggatgagggcaggaggggctgagactggcacctgcaggatcagtaggagactatgtgagatcctgaacccaggcgctagaaaggagggctgtcactaaatagccattatcaaataggtaggtttgataagacttggtcacctctagaagtgggaagaatatgggaggtcgaggcaggagaatcgcttgagcccaggagttcaagtccagccctggcaacttagtgagaccccgccgtctctacaattaaaaaaaaaaaaaaaaattagctgggcgtggtggcatgcacctgtattcctagctgctctggaggctgaggtgggaggattgattgtgcctgggagttcaagcctgcactgagccctgattgggccactgcactccagcctaggtgacagagtgagaccctcaacgacaacaacaaagcggagagagcagcgaaggaaagggaggagtggggtgatctccacatttctggtttgctgatggggtacaaggtgagctagataactcggcttattttggggtgagttgatttggggatgtctatgtgactttcattaagagaagcctgattttctggtgggatgtggttggtgtaagtatggaagtctggggaaaataagacaaagtattagatcaccagcattcaagtggcaggcaaaggagatgaagaagggaccttcagagtggaatgagaaatttcaccaatgccagatgttgcataaagttcaatgaaagtgaggaaggaatctggtagattttacagtgagcatttcatataatgccctttgccagaacattttcagtggaatagtggagatagaactctcgatgtaatggggcgaagtgtgaagaggtggagaaatttaaatagcatgtgtagactattttggggaactttgctgtgaaggacaggagacgaggtggtaaccactcatagacataggagtgggggacaaggtttttaaaaaagaaggtgtgagaggcttaagcttatttctagataggggaaggagtcccccgtgtggaggaggaaaataccagcaagggattcaatcccaggaatgggctgttatgggaagaaaggaaagcactgcttggtgttcatgcacatgtcactcagtctgtccgtgttgagccactactttttcttttgaaagctacaaagggtatctaatccaactctgatacttatatcaagcacctttaaataaaaggtggactttaaaaaaaacagctttattgagatatcagtcatatacaaaaggtggaatttatcagttctttctctatacgttcccccttccatttcatactgaaaacctcatctactctaccacttacggacatattttttgttggtataaacaggtggtttgttttccctactgctggaagcgaagagctttttaagcaggagaattactgcttagcgcctgagaaattctggactgggacttctgctgttcatatcagcaagtgatttttgttgtttttgttaaattatctcatctacattcttcatcctgagtatttggcatacaaattcccccttttgagaggggaatgatggataagaataatattagctgaaaagacagactgaaaatctggggacttaagttctgttccctttgtaacgttagctagttttatgactttaaacaagtcactttgtttccttatctctaaatgctcttgaagatcccttcaagacagaatactgtgcttttttgattcctgttttgtgtagcattttgtggaagagtcactggattaaggtcttttaaaattaatttaaaaacatatatatctccaaattactagcttgataatttgttaaagaatacttactgattttctttactaacaaaagaatttttaatgacataccagtgggtattgagaacacttcagctacattcacccacagtcagctgatatttagctgatatttagctgactgcggagaagtcatgtgttttgaatataagaataggcactttcagatgttctctgagtgccagtaattagagtaagccttaatccactgtgctaaaaataaccaaacatacctttcttcttactagtctattattaattttacttcagatttagacttacaaataggcactaagagaacaaaatgagctcattattgatttttttaaaaccatttggtcctaaatataggaagtacacttcaggttctcttggtaatcttttactaaatcagtatggcatattttacttctcttcaaagctcttaaaatattgtttcgagcacattttaatttttgccaggtatgggattacgttaatgcaattgctggctatagtttttaatgtaaaacttgggctctagagtcaaattgctgttcctaggcaggttactcaaacctgggtctcttatcaatgcaaataataatggtatctcatggatacggttgttgtgaggattagagtggtaaaatatgcaaaagccttagctaacatttaatgtctcatgtagggcgaggattcagtgaatggtacttaattattatgtttctgtttttttcctgccctaagctttctggaaagaggtacattattatcctgatagctatctgttcacctacaccaaagaattcattaatttgattattctttttccattccgagtgaaagtaaacattactggctggggcttagacacattgtttctgatgatttttaaattaatgcttccaagtgattcatgcagtttaggacctttgactagtgtttaagtgctttttatttgtaagtaaagaggcagtactgtggataaggagcgaggatggtacgagcattagcttgtttaatagtagcatgaggaaatcttaaataaaaggaattttacttgaaactgttagtaaactttgtataataaattatttagcattctgttcctatcagctagtcatatctggtttttaatctaccatttttatgtcagtccctttaatgtttagttttcttaaatcagggaatcttatgtgtcatttatcagtttcctcaaattcaaagttctatttaatgagcatgggttagggaggatggagagttggaatactctattctcttttaaatagacaaacaaaaacagtaacgatgggaaagagagggagcactttgttaaagttggcattgatgccctgttttgtcttccatgacttattcccttcacaatgatgataaatgaacacatgtgaatacctcctctcaataagactgcagtagctccaccattttaaataacttactgagtgtggaagtcaggtagagtagacatgcacaaactcatgatatatatgccaagtgagtttgtatgatacagtggaaaaaggcctggagttaaggtcaaaagatcaggtttcttatcccagtactagcacttgtaggcgctgtactcttaagcctcattttttttttgtctttttttaatctgtgatcaaggatgaaagatagtacttgctgttgaaaacatcaaataagatgaaatggttttaataatgaaattaatgctgttgtgtgaatactagttattttcatactaaggagcaagaattcattgagtctcaaaacaggttgtgttattctgtatacagtattattttacattaatgctacgagcagtaactgcccattgtgttttctaaaaatcatttaagtgatcttcagtgaaaattataatctccactgaaatgttctgtgtttagcctatcttaggtttttattttctttcttttcaaaagccttaagtacatgtaaaccattttaaaatgcccttttaatcctcctcaaaggacttgctatgcctcagggttgaagttttgcttccttgggtcaagcataacatgattccatatgctagaatcctaatttgaaggagaatataagtttcccaaccttattccctcttctagggtaaataaactacacttcagttcaacagtgtagaacttggtaaatttgagaacaggcctctgtttcccttaagtgataggaactttctgttctctttctctaacttctgtaataacgtggagctgttgttcttttcgtatggtttattctgcaatcctagaaacctttttaaaaacaattctattctgttagaagtcaagagcatagttacccttgggggtgggaggttgtgactgggagagggtagcagaggagtttcagggttcagtagtgttcagcttcttgatgtgggtgctgatatatagttgagttcactttgaaaatttattgagcttgtaggacttaaggtcttctctgtgtatatattatacatattccaataaaatatcccaaaatattgacctcaccttggcattatcctcaacaagtcctccttcagttggaaggtttgttttcttctctgtacttacagtttgaattaatctgctatatattttgttttaattaagtaaacttaggaaaaacctgggtctgctatgttttaaaatgcttatagaaaagaacctgaaaggaagaagggcaaaatcacttattctaagtggtatgattattttgattttttctttatacttgcctatgcttttcaaaatttctgttatgcgtttattacttttgtagtctatgagaaaaatctgtactgtcgtgaaagaagaaataaactgtataaacttggggcttttcataataggatatgaaaatatatttagaaaacatcattataggataacagtttttttcacatttgtactttgttacagatatgctagtctgtatttttgctgtgctattgaggatcaggacaatgaactaattaccctggaaataattcatcgttatgtggaattacttgacaagtatttcggcagtgtgagtagtattttattttaggaaattgaatgccatagtatattttggaaccttttctctaacaagtttattttttggttgtcttggggattctaaccgcgggagagggtgggaatgactatttattagtagaaattattaagttgtccatattgggaacatgcagagcccagtcttatttagcttgtaggaatatgttttcaagtacttgagatttggaaattaagcttacttaaaccagtgatacttagtcatttttagaaagagttaagattgattcactctagttcgattttattcactacctgatagtgaataagcatcttctgcttctgcaagttttaacaattttttcttttcttttttcttttttttttccttttcaggtctgtgaactagatatcatctttaattttgagaaggcttattttattttggatgagtttcttttgggaggggaagttcaggaaacatccaagaaaaatgtccttaaagcaattgagcaggctgatctactgcaggaggtaagctacttattctcttcactaggcactagcatgttttgctcttgctggggaagtctcattcatcattcttacagtttcagaaagtactctgaagcatgcttgtcatgtagtgtccatccatgtgcagtttattgactggaatatgtgtcagtcacgtcaactcagttatctatggatggatggttcagtttggagatggtctatcggtcaggcctcttcccaatggccctttttggaccctaaaacactggagtctaaacctttagaggacagactatttgaagaagggaaaagattggctgaaagtagcagtaagttgagaactctccatctattgcttcaaattgtttaagataaccccctttttcattagtgtagataatcaggagttgactatgagattatgacattttaattccaaattggctcatatttttacctcatgtccattaaatgcaaaagtagccaagcaaatgatagtgttttctaattatactttttgtagaaacttccaggttttttttgttagcaaaactaaacagtatttgcatttctctttgctcttcttaaataacaaaccatgttctgtcaaactgcattcttgtcttacctccatatccccagatgtgtaactcccttttctttctaattaccatagtcatcttgggttaattgtgcagttgatgctgatgtaccttctatttctgaagcttaacatttcatagataaggctacctttttccaaaaacttaatgataccttaattcagataccaaattgaattatgctttagagctaattgtgatttttatcatatggaaagcttacagcatgagaagtgattagtaaatattgaaaaatgaaatgtgttttcactaaagtagttgttaagtgtgtgtttgcatgtatgtaaaagtcttgaatatttttggctcactggttcattttccagaagcattgaaaatatgattttgtatttccagtttattttagtcccttctttgttacatacatgtttatcagtttgttcttgtctttttttagtcaccaaaggtgactttcagtcccattttttagccttggaggcattcagttttaagggagtgaaataaggggagaagagtaacttactttctccattttaacttcttaactcttggactctgtgaggaagggaaagctgtttgagaatctcactgcatcagtcactgactgggacagttgtggggattgcttgaagttgagatgacatcatctggatagacatctactaaatgtgagacaatgcattgtacacttaatgatcttgtagttatcagaagagtggttaaggtgcctgcaaaagtgaagtattagattggcagccctggtgccatctactcttcagtagtgaaatgaacacagaccttttgccttgtgtgtacagtttgccacagtggtttaccaattgattggaaatgttattctggaggtttgtttttaatatcaggtgcgctgactataagcatatactctactgttgtaaaattggtttttaaagttagtatctccttattttgctgttcactaatcagacttttttaaaaattaggtcaaaaccaggattagaaattgggaatttttcatataggtcttcccttgatcactttcatattttgtcacagatctgtattctgctctgtcagaacctggcatttcttccaagtttttctatcattttctgattaattacattggctttaaaatgtatttaaagttattgaagttcaacttttaattttaatatttttcctggagagtaattttttgtttgtttgtttgagatggagtttcgctcttgttgcccaggctggagtgcaatgacacgatcttggctcactgcaacctctgcctcccgggctcaagcgattctcctgcctcagcctcccgagtagctgggattacaggcttgcactaccatgcctggctagttttgtacttttagtagagacagggtttcaccatgttggtcaggctggtctcgaactcctgacctcaaatgatccgtcccccttggcctcccaaagtgctgggattaaaggtgtaagccactgcacccagctgtgcctggatttttaaatgctactgggaaattgctatgggccttagaatatgacagcaatgttaagtttaccttagagcatatattcagtatttaatgtactaggggataagaacattattgcagatccacatttatttgtgtgtgtatatgtacatatgtatatatattcccctatgggagtattttaatagttaatattgtccttctgtttgaagtactatttttatgtctttttttttttttttttgagatggagtttcgcttatcacccaggctggagtgcagtggtgcaatttcggctctctgcaacctccgcttcctgtgttcaagcaatcctcctgcctcagcctcccaagtagctgggactacaggtgcacaccaccatgcccagctaatttttgtatttttagtaaagacaggctttcaccatgttggccaggatggtctcaaactcctgacaggtgatccacccacctcggcctcccaaagtgctgggattacaggcgtaagccaccgcatccagcctatttttatgtctttaattggggaaagtaagtgcaaagagaaaagcataggatgagtatggttggtcccatgtaaaattttccttacccccttgtaacctttgtttaaaataaagaaatgagtactgttaattacagttccttgtctttagaagaaagctgtggtcctgtttctcttctatgactacttttacattgctttgtacacaaacgaaactgagtaccacattgagacattgtctatttagcagtctgagtgaaccatttttcttagccatgtaggtcttggggaagcagtaggtggtggtccattctgaatttagagtgagaatacatcgtaggttaaggccattatgaagccaagctcaagtctgtgtggagcagtaaggcttcaggttattctgttctcttcatcaacatactctgagaagaaatgcaggaatggcaagatgcatgtttcctaaaaatagattcatttatatttttgatgcatgatacaagtttacatctgtgggagagtatttgaatattatgttcataaaatagcaagtggaataagagaaaaagcactccacaaactgctggaaaactttttgttttggataccatgacaacaaaaataattatgatggtaactaacgcttgagtgcttgtatgtgaggccctgggctcagcagtttgctttaagcatcctgtgctaatcctcaagacaccctgtgaaaggttagaggtagcctaatgagaaagtggaatctcagtgaggttccatgactggtctgaggccacctggttagcaactggcaaaaccaggattctaaacccagatctactaggcttcacagctgtgtaaaatcttaaccactgtgcacttcccctaaccccagttatgtattgtcttggtatatatattttaaacgttctgttttagatatgaacttctttgtttctcagtcatatagtgagaaattcataattctcccagaggtttttctgtgtggaaaagagtagatttcctaagacagtgccatctttgacttcttagactgcaaatttttattgtccagattatcagcagttggaattttttattggatatgtagatataaataatatttttcaacctatttcttgttggattgatcaaaatgcctggatttataataacttttttggtcttatagtttggggtatagcattcacttaatcaatttcatgaaatgattttgcttccaaaattgtaaatatagctgtgaagatctaaattcagacttacatttgtagtagaagtcctaattggtcaattttaatctactttttcatgtgtcattatttttctgtttagtgtcaggtcttttacttgaattgattatttctaagcaccaaagatgactttgaacttatcatgtacttatctgttggcttaaaggtgtatacacatctcaatgattttgatttttttttaatttgtgaaatatacatttctatccttaagaatgcttattttcttcagaaaaattaaaaaaaaatttctcttacccaatttgtataaacacatagtttaaggtagtccttcattttatagccaaatagggaagagggtcagtggatacagattttctgttagcatattacagttagtaataaaaatgtaacattaaatgtacattcaaataatagttgctaaaatattagcagatattgtgattagataataaagatatcttttttattttacttcattacttggtaaataaaggattagttttgacatttctagaccaaacttcatgtttattccttttggtgtttggttgtatgaatacataattagatttgggggtaaagcccagaaattggcccgttatccattttttaatgtttggctgtcttaacatgccactggtactaaagatgattcttaaattattaaagtacaacatgctgaaattgctaaattgatattctttgcaatacttggaatacttttccccaccacctattttaagctagatttttggagggatatggtggggggtggtgatgtagttggatttatttaaacacacacatatataatgacaaaggaaataatagtatggctttttttctgtaaagtcaagcacttaccagtttttctctgctccttaattttatagagccagaatgaagaatggggaggtttgtctgaggatatcttatgataaagagcagtctaaggctttagtccctttgatccccaacttatttattggtaactactaaatttaccatttttgtggcatggataaaatggagtgctatgcaaatactgttgcacgtgagatgatttctaagtccttgcttgatccgtgaagatcaaatagttaaatactgggcatttgggctttaacccttagcggttgatgcatgatggtgttgattagtgctttgagatgtgtcaacctttcttttttatactaacagcatcattttgaaatttgtggtgttgtttttcttttgagctttgtttgctgttggtattttttctcactaaagtaatctgtgaaatgcaaaataagtgaggtaccaaaagcaagcataatactcatgaatttgcttttactttgagatgatccactttatgaatagatttactggatttgcagttgtttatctgcctcatctagaaagtggtactctacggaggattagcgctgctaaaattgatttgttttagtgctgggggctgcatgatatatcttagtactatgctatatttttgtgaaagtaataatctgtgggactgcatacaaatggaaaggtaagaatcttaggagaaaagtgatttcttttaaaaaatgaagcttttgtaacttaaaattattttaataagtactttttgaagtattgaataacatatcttttaatatgaagttttggactttttaaaggtcagctcttgatataattaagaatatttgggctgagcacggtggcccaagcttgtaatcccagcactttgggaggccggggcagttggattgcttgagcccagaagttcgagaccagcctgggcaatgtggtgaaaccccatccttacaaaaagtgaaaaaaaaaaagactagctgggcatggtggtgtgtgtctgtagtccaagctaattgggaggctgaggtgagaggattgattgagccctggaggtccaggctatagtgagccatgatcatgctactatataccagcctgggtggccacagaacgaaactttgccgaaaggaaggaaggaaggagggagggagggagggaaaacagaaaaaagaaagaatatttgggcatgctagtccaacttgagaatatcttaaattgttttaaaaaaagagatgcttccaaatatgtacaagaatgtcatttaacagcaaaaagcattttgatataaatcctcttagatttgcttaaataagacaaactcgtgtaactcctttgtaattactactgttcatgttaaaaccttcaagcctcttttaaagttaacaagactatagtcttttattgccagcgtactttagtttttttataggtaaacttaatcagggtttattataacaaattctggacaaatgaagtttgattacattaatgcttgaaatggaagtgcttgaaaggaagggcagaaagcaggacaaatgttgcctttcattttacatttaataagaaacaatttggccaggcatggtggctcacgcctgtaatcccagcactttggaaggctgaggcaagcggatcacttgaggccaggagttcaagaccaacctggccaacatggtaaaaccccatctctacaaaaaatacaaaaattagctgggcgtggtggtgcacacctgtagtcccagatacctggggggctgaggcacaagaatggcttgaacccaggaagcggaggctgcagtgatccgaaatcaggccactgcactccagcctgggcgacagagtgagactctgtctcaaaaataaataaataaataaaataataatttggccagtgtccttactctctggttctcaggttgtagtcattttgctttatgtgtttttgagccttttttcttttcatacttttcaaaattttgaggattttccgcttgctatttctattctattcttttcttaaatgctgatcctgacctagtaatttgatttcatgagccctagggttggaacctgcacagggacctgcaaagggaatagtctgtggtgtcggtggtgattttttttttaattaaaaaatactttctgaaaaatgtcacgtttgagtccttttttcacctactgacattttcttttgtttcctctgagggcctttttttaaaaataaaaattcccattctggaaaaattagcaaatacaggcaaacacactagaatataatcttacccaccaactagagccaattagattaactcagtggttcccatggagtgggagtggtgcagttgtgcccctctaggggacattgggtaatgtttggacacatttttggttgtcacaattgggggtgcagtgctaccggcatccagtaggtgaagaccaaggatgctgctgagaattctgcagtgcacaggacagcccccttagaacgcggaattatctggcctcaaatgtcagttgtgcccaggttaagaagccttggtttaatttaacactatggagtaaagattccatttacatttatagactgctatatcttttcaatattatatgtagaccacagtataaataagtggctaaaaattaatcaaaaatgcaaaaaatcaagaaaggataaatgtgcttaagaacatacaaatagctataaaaatcattcctaggccaggcgcggtggctcacgcctgtaatcccagcactttgggaggccgaggtgggtggatcacaaggtcaggagatcgagaccaacctggacaacatggtgaaaccctgtctctactaaaaatacaaaaattagctgggcgtggtggtgcgtgcctgtaatcccagctacttgggaggctgaggcaggagaatcgcttgaaccagggagtcggaggttgcagtgaagcgagataacgccactgcactctagcctggcgacagagtaagactccgtctcaaaaaaaaaaaaaaaaaaaagtcatctctatgattcaccaaaattacctctacataatgaccagttactggggagataatctatggttgactttagaatccaccctacagcaaggcttgtaggatgtcactctataatttaatttcctcaacaacagccaaatctgttaacttctattaaggtaattgagtttttatgtggaaactgaattgagtataccctgcagacagaacacctttgaattttctgccaatctccccagccactttagggatttgttaatttcttaaaggaggaatagttcaaatgaccagaatttacatatatagacttttgttgcatatatagactttttgttgttgttgttctctggcatcctgttagccttaaaggttttacttagtgaagatatttagtagcatttgagtatttgaaattctgtgattccaagaaatcttttacctttgaaaaaccctaatttagggtattccaaggcaaatacaatacagcatgtcctaaaacatgcttaaaatatttctttgcagtctaaaattatatttgctagctgggcacagtggcacacttccataatcccggctacttggaaggctgaagtggaaggatcccttgagctcagaagtttgagaccagcctgggcaacatagtgagacccctcactcttaaacaaattatatttgctaagttaattattctgcttttttttgtttgtatatttgttttgagacagggtctcactctgtcaccaaggctggaatgcagtggcaccaccatggctcacttgcagccttgaactcctgggctcaagtgatcctcccacctcagcctcccgagtagctgggattacaggtgcacaccaccatgcccagctaattttttaaaaattttcagtagaaatggggtctcgccatgttgtcagggctggtcttgaactccgaggctcatgcagtcctcccaccttggcctcccaaagtgctgggattacaggcgtgagccactgcacctggcctctgcttttttattttaaaagcacaactaactggtagataaagtgatttgtctttagtatttgataactaatgggttttagagtgttatttataagatgtagtaaattatcctcatcattatttttaagacaaatttataagacaagtgtaatagaaatagatcaacagcacaatagaaaaagatggcagaaaacatgaatatgtaattcacagatgaaagcaaaacaaatggtccttttattaagggaatgcaaagttaaaaatcaactagacccttttttgtttgtttcttcttggattggcaaagaggagcacttaaaagctgtattttgttttggaggattagtttggttatgtctactaatgactaaatgtgtacatacattttgacccattagttacacttcaaagaattttatccaacaaaaatgtactgagacacattgcttagtataataagccattgaagcttacccaaatattcatcaatgagaaataggttaagaaaattatagtacaaccatacatgaaactgatgtagctgtaaaagaaatgagatcgatttttttttgtaatgatatggaaggatactcaaagtatatcaagtgagaaaagatctaggaacaggatattattattattattattttattttttgtagggacagggtctcaccatgttgcccaggcttaggagcaggatattagctaactcgtgttacttctgaaaatctttgaagctccccctgctcttttttccagaagtgtaaaaacaagcatgtatttagtattacacatttttaaaaaatgaaaaaatgctgctgtgtgaatgaaagagtatacatcgtgttgctccagatggtaaaactagagtagaatttactaaaataaagtttcagcacgtaaagtaaagcacttctctgctcttggccattttagacactaaccatctggagcaaccatgtaactcttgccactcatagctaacttaatgtaaaaaaaaaaaatcgcttgactttcttagcacttcacaaatgcttgtaagactgacaccaggagccctgtcatctaaaaggcactttatagagtgctttcaattcttctgttttttcattcattgctcaaaatagatcgtagtgagataagatagtctctggccttcttggtctttggcacaaggaagagggttccagagttgagagtaaggactttgcatcctttgccatagaatttgattaggggccataaaaaggaccattgtgttctagaatgtgaaggactaagcataccactttatagtgcaaggaataagtgaagaagtccttttataagaaaaactgcagtagagcaataacttgaaattacacttatttatatttacttttcattaaatgtaaattattttcttttaccacattgtactactagaaagagaatcaggagtttaggcattcagtcatagatattcgataccattgatttacttaagcacttctcatgtcaacaagacttaagcctgcagataattcctattttatcagtgttcgttatagcttccctgttggttttacttgtgagtcataagcctagtatggtgaatatctaggaaatttcacggtaacagggcttgtcttaggttttgagaacaggtgtaacttgacttctctctgctgtttgtcatcctacacttcccactacatctggtcctttttgtagggtgttgagaacaacatttttcttcatgcaggggaaagtggaagtgcatgttttctaagaaggacaaataggaatagaataaaagaaaaagtatattggggctgggcatagtggttcactatgtaatcccagcactttgggaggctgaggcgggtggatcatgaggtcaggagttcgagaccagcctggccaagatggtgaaaccccatctctactaaaaaaaaaaaaaaaatacaaaaattagccgggcacagtggtgggtgcctgtaatcccagctactcaggaagctgaggcaggagaatcgcttgaacccgtgaggtggagattgcagtgagctgagatcaagccactgccttctagcctgggcgacagagcaagactctgtctcaaaaaaaaaaaattatatatatatatatatatatatatatatatatatatatattttggaagggagaatgggagtggaatcaaaaacattggtctcggatgagaagagtctttctcattggttatgtggtgataatggggtaaagctgtagactttttttttctttaattcatgagtaagatgagcaaaattgaggaagtgtcattttcttggccttgagaaatgacatcatctaaaggagaatcgttgggactggggagaaggggaggggtgtatagcttgaggacagtgtgaggagttggcagtagacttggtggggagcaaattagtgaggagcaaaaaagatttcctgggattgaaagcccgtttcaggttgaaataatacattgtcatccttattcaaagaataggtctccagagaacctgtactaaggacaatacatggtttatagttgtacaatacaactggattaaaaaattttttctcactgttttcattctgacctttattcccacttaattgaaatcactggggttttagtgttttaagaaacggatagtttgctgagtattatatgtgactatttcctacgggtgcccaggggaagaacaagatagtaggcctaggcctgcacagggtcccttgtgtgctatgacagactttactctcaccctccctaattcctaattgatataatttttatgtgactcacaagaggtactggtggtaagaggtataaactggaatttataattgaatctactttctttgtatctgaaagaaaaatattttggttaattatgggcatataatttagctaaaaaattaccttaaatgttaagtggtccttaaggcatttataacagaactttttcagaccctagaagtctaaactgggaaattatttaaaacgttattaaagcaatttaaaatggtaaaaataatacatttatttttgtgcattttagagtttcttttcttcttgaaggatgtttttccagtgaagaggggtttctccctatgaagagtattctcacatttaatagatggtaatttcttacttaagtacagtaatatggatcaatggctataaagaatagtttggcttatcatcaacccttttctttcctaaaagcagtaaaaggtgtgtcagggtataagtggtggaaatgcctgggtggtcacattgagaattgttcctgtagaattgctggtgtagttcatagtaagtctcctggggaggaatggttgcatactccgccctgtttgggaaaccacctcttctcttttaatgagcgtaagctctcgatggttggtttttacatggtatgatagaaaattaagagagaaaagaaaaagatgataaactataatataaaggctcaaagaactggtattatttaggcaaaaggttatttgacagattggtattatttaggcaaaaggttatttgacagacttaaacttttcttgttctctctccagaaaacagagactatgtatcacagcaagagtttcattgggtttaagaaagcgtactagaatacgtgctggagtactgacatgcatcaaaatgtagtaggatatataaattcagtttgtaatgacaattttgtcaagtttgttatttatattttagcattacctgaaaagtctaattacattaaatcccaagggatagtcccaattacttcattaaactggtattttcatagggaattttgcttggataatgatccattattggggcttataatttattttttacacagaatatggaaatagcttcagaggttcattgacaataaagcattcattaaatactgtgaatcactaatgccattgatacagaagaatttccctatgaaaatgagagcttctgtgagaaaatgaagtagttgggagtttaatttcttattaatatgattttaacttgctgcttcattccactatattctgagttgggggaaaagggcagctatctctttaaaatatttaggaattctttgaggattaaaatgtaactggcttttgtcctcagatacgtttgtaattaatggttgtgtaagtttagggatttgttagatatttttcttggaacagtttacatgattttgtagttcaacatttcaaagtttcaacttgaataaatattaaaatgaggatactttaaagacactcaaataagcaattttaaacttgctttctggtggggatataatccctttgagagtctgaaggatgatgggctgtcaccccaggaaaatttgcacatcattttgtttctaatttcagggaactctcagagcccctagaagtccttctgtagacactcaaatctggagagttcgttaaaatctgtcttgaggatttttaaaaaagtaatatcctcagtctcagtcaaattctttggattttttgcttttgtaggtataagtaaacggttaaaaaccttcattgctacttaaaataccagatgagtgactacttttccagtttttattgggaaagatttttctctaggttctttagtttatgtaatacaaatgaactaatgaatttaaatactggtggaaggggaatattctaattgaatttttggtcaactcagtattgaccagatgacttacactgaaaatcttttcataatattagtagtaaatatagtgttttaggattttgtaaaatttctggaggatgtctgtcatcattttgaacactgtatgtagtaaagttagaaaaaaatgaatctaaagtcttgggcattgtttagaagttaaatattcagccttaaaccaaagaatgaaagcaaacagaaacttaagttttagttatctttactgtgagctaaatgttctagaaatctgattgtgtctgtgtcagtttgtatactgtgtgtaagaatatatgcatttcttttgtagccacgtcatgaatattttaatgtccctgtgtactaaatgactactcatcgagtatgcagaatttcacagaggaaatagaatgctgatatacatatgaaagaaaatatcctcagcatggtgattta

SEQ ID NO: 5508 - DNA, 22749 bp, human
atgccagccgggtgtcctccccacagcaccacggcttctcttcctcagcacggcgacaggggcttccccttcgccgccgccgccgccgccggccaagctccgccgcgcccgcggcccgcggccgccgtaagtccctgggggcgaaagggggcgccggggatgggggagagggggagggaggactgggcgcgccccccgccaccccgcgcgcgccccgacgaccccaccccgagcctgcccggcccgccactgggtcgccgcgcccgcaactcacttctctccgtgtccgcgccctccgcaccactccgcgccgcgcccggggatgtgggggccagtcccgggctccgcgacagcctcgcggcacctgtggttcgggaatcgcctcaagttttgcggggcgctttcgggaggggccgggggcggtggcggccgaggactcttggcgccccctgcgcggcggcggatgccattgtctgctccgctccttgcctgtcacctctcccgggcttggtcagtgatggagtgtggccacgggagtgggggggaggcaccggcgacggccggacccgaggaacgctggccccgagcccgcgccgcggctgagcccattgtttttaatgccagtctcgaggaattgtggtgccctgtgatttgcggcaaaatcaaagcgttggtttttaacacgagggaaggaatactcgtgctttgcaaccgggtttcgtcccatgttaggacataatttattttaaggagaatacattgttttttcgtcctgcaaagtggtagggcggatacaggaccctgctccagacagccttgagcccatactcttcgcaggcaaaccctcaccctttctggtcaccaagatctaggaatacgaggtccattcttttccaagttctggtaacgggtttgcagtaaatgcccagttgatgcttcacttcctgcccccttcgaatgccgctatcttcaggacttgcacgggaggcactttggtatcacctaataatgtccttatattttgttcccctgacgcattttaagtgaggtaataagaccattttaactttactaaagttgaattgccacgtcatacatttctagatatcttgttgatacctttttgggtggttacaaaaagcgacgataatttcttaccgaaatttagggcccatttttattctacattggttctgtaaatttcccctccccgtgttcaaattcaagatggtgtggtgaatcttgagaatcatgcttgaatcttatttgcagtaacgctgttaaaggaacttaacagtgattaaaagaaaaaaggatacctatgtgaattctgcctttaaattacctttgtagaaacaatacttctgtttgcagttgagatgaccaattggattacaaaaagcttggcgttaaaaatgaaacatgcagactaatcaacacatttgcagatcacaaataaatacatacaaattagtttaagtataaaacacactagaattcagcatccattccatctgtagatactattttttattttaaatgaagtatttcatgtaatgtttcaatgctgaatcttatttaataagtgtaaatcttattgtggccttttaaacgtttgttttctttttcataatacattaactcagttctagattttgtacatatttaagttggaatgctttaaaagtcagatgaaaacatacttttttattaatgaaaatttgtatttatgggatttttcagttaatattttggatcattctgttttgcttaaaatatgccatcataaactgaggagaacattccaagacataagctactgtctgcaagtaattcaccctggaactagaacggcctcaggatgaaaaatagcaggtcttctgtttctttcaaaagtacccaaaccagatgatgtctaccattctcttttgatgcatatagagagtgcgcaatgtatagcacaggtagaaaatagtttcttaaattgaaagagtgatctttatttttcttcaaaaatttcacttcagcttattacccatttttcttttttctcctgcacactccccttcaaacttaatgtggaacaaggtgggattggaaggtttgcatctagaggaagatctgtccaaaagaatttcttgctattttaattggcatagaaatattgatggctactaatcatttgtcatgtaaatgccccatcccccaaaacttctctgtgaaacacataatcttaactttattgattcaaagtattacatgtaatcttgattttatttatcttaacagatgcagtttatgttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaaggtataatttttgtttgtcagaaaggtgaaatagaatcaaatgttaggtcatttaggaaattgcagacttcagtgatgacatttataaataacgattaataaagatttagatgaaataggtttaaggtaaagctttgtgtttttaaaataactagtgttttgattgataattactgaggctgaaatgataaaggcagggaaatcctttgaaaactagttatataattaaaggcataaatgattattcatgcttaatcatctttatagaagagtttaatgaattcatttcattgcaggggaaagtagggtcagtattttaaattgtgtgagtaattctctgaattgagacaagtacagatagagtctaattctttttccccgaaaatctataaagtaatgactaatatttgacatgccttttatctgatttttagaatcttactcacgtgtaaataccttgactatgtagactatttcaatcacatagatgttttaaaaactttgtgtatacatgagatgtgtttgtaagtagtgtttattaacttttaagtacccttgttgctatggtgggggtgcaattaaatatgacagataatttttccaaggacagattttttaaaaatttgatgttacaaaatgactcatagattggcttttaacactaaaatttttttaatgctatacgtctttattttataaatatctgaaaccctgaataccctaaaataaatttctcaagattgttctaagtaggttaaaagaaataaactttcttcttttacagaacattttttgaggggacatttacttcattccccatttgtttctttttgaataatttgctgaatttaagataagagcatttctgcatataaaaagttctcttgtgtggggagtatacatggaagtaacagtatgggatacaatgagggtgggagagaagtctggttttcttctcagcttccctttattgcactccaaatatgggttggatattttgtcagggagatggctgggaagaaatggagattacaagacataagtttcttaaatactgaggactcctctttattattgaatgatctttggtgattttgtatctttgggtgattttgtatccagtgtttcgtttggtcttattaaagattatagaaaagtcatatcatttgagaggtgagagatgttttacagtgatctagtcaggtgattttgttttgttttgttttgttttaagctttttgccccatgggtagaaccttaaataaaatgagtggaagtgaggctgctccttgtgaaatcaggaatgaggatcctgtatcctggctcacttggcctttacccctctgcacaggagacagttcttgagtttgaaaactgccgttgttgatcaaacttcaattttataaagaatgcaaatttgggagaagtgacttgtctagggccatatgccagttagtgattgacatggggctgcaactcagatcttaagcttagaggcaaagattttaaacagggctggaaaaagatcaggtttacatatcttaaaagattgaactgagacaatggatgagggcaggaggggctgagactggcacctgcaggatcagtaggagactatgtgagatcctgaacccaggcgctagaaaggagggctgtcactaaatagccattatcaaataggtaggtttgataagacttggtcacctctagaagtgggaagaatatgggaggtcgaggcaggagaatcgcttgagcccaggagttcaagtccagccctggcaacttagtgagaccccgccgtctctacaattaaaaaaaaaaaaaaaaattagctgggcgtggtggcatgcacctgtattcctagctgctctggaggctgaggtgggaggattgattgtgcctgggagttcaagcctgcactgagccctgattgggccactgcactccagcctaggtgacagagtgagaccctcaacgacaacaacaaagcggagagagcagcgaaggaaagggaggagtggggtgatctccacatttctggtttgctgatggggtacaaggtgagctagataactcggcttattttggggtgagttgatttggggatgtctatgtgactttcattaagagaagcctgattttctggtgggatgtggttggtgtaagtatggaagtctggggaaaataagacaaagtattagatcaccagcattcaagtggcaggcaaaggagatgaagaagggaccttcagagtggaatgagaaatttcaccaatgccagatgttgcataaagttcaatgaaagtgaggaaggaatctggtagattttacagtgagcatttcatataatgccctttgccagaacattttcagtggaatagtggagatagaactctcgatgtaatggggcgaagtgtgaagaggtggagaaatttaaatagcatgtgtagactattttggggaactttgctgtgaaggacaggagacgaggtggtaaccactcatagacataggagtgggggacaaggtttttaaaaaagaaggtgtgagaggcttaagcttatttctagataggggaaggagtcccccgtgtggaggaggaaaataccagcaagggattcaatcccaggaatgggctgttatgggaagaaaggaaagcactgcttggtgttcatgcacatgtcactcagtctgtccgtgttgagccactactttttcttttgaaagctacaaagggtatctaatccaactctgatacttatatcaagcacctttaaataaaaggtggactttaaaaaaaacagctttattgagatatcagtcatatacaaaaggtggaatttatcagttctttctctatacgttcccccttccatttcatactgaaaacctcatctactctaccacttacggacatattttttgttggtataaacaggtggtttgttttccctactgctggaagcgaagagctttttaagcaggagaattactgcttagcgcctgagaaattctggactgggacttctgctgttcatatcagcaagtgatttttgttgtttttgttaaattatctcatctacattcttcatcctgagtatttggcatacaaattcccccttttgagaggggaatgatggataagaataatattagctgaaaagacagactgaaaatctggggacttaagttctgttccctttgtaacgttagctagttttatgactttaaacaagtcactttgtttccttatctctaaatgctcttgaagatcccttcaagacagaatactgtgcttttttgattcctgttttgtgtagcattttgtggaagagtcactggattaaggtcttttaaaattaatttaaaaacatatatatctccaaattactagcttgataatttgttaaagaatacttactgattttctttactaacaaaagaatttttaatgacataccagtgggtattgagaacacttcagctacattcacccacagtcagctgatatttagctgatatttagctgactgcggagaagtcatgtgttttgaatataagaataggcactttcagatgttctctgagtgccagtaattagagtaagccttaatccactgtgctaaaaataaccaaacatacctttcttcttactagtctattattaattttacttcagatttagacttacaaataggcactaagagaacaaaatgagctcattattgatttttttaaaaccatttggtcctaaatataggaagtacacttcaggttctcttggtaatcttttactaaatcagtatggcatattttacttctcttcaaagctcttaaaatattgtttcgagcacattttaatttttgccaggtatgggattacgttaatgcaattgctggctatagtttttaatgtaaaacttgggctctagagtcaaattgctgttcctaggcaggttactcaaacctgggtctcttatcaatgcaaataataatggtatctcatggatacggttgttgtgaggattagagtggtaaaatatgcaaaagccttagctaacatttaatgtctcatgtagggcgaggattcagtgaatggtacttaattattatgtttctgtttttttcctgccctaagctttctggaaagaggtacattattatcctgatagctatctgttcacctacaccaaagaattcattaatttgattattctttttccattccgagtgaaagtaaacattactggctggggcttagacacattgtttctgatgatttttaaattaatgcttccaagtgattcatgcagtttaggacctttgactagtgtttaagtgctttttatttgtaagtaaagaggcagtactgtggataaggagcgaggatggtacgagcattagcttgtttaatagtagcatgaggaaatcttaaataaaaggaattttacttgaaactgttagtaaactttgtataataaattatttagcattctgttcctatcagctagtcatatctggtttttaatctaccatttttatgtcagtccctttaatgtttagttttcttaaatcagggaatcttatgtgtcatttatcagtttcctcaaattcaaagttctatttaatgagcatgggttagggaggatggagagttggaatactctattctcttttaaatagacaaacaaaaacagtaacgatgggaaagagagggagcactttgttaaagttggcattgatgccctgttttgtcttccatgacttattcccttcacaatgatgataaatgaacacatgtgaatacctcctctcaataagactgcagtagctccaccattttaaataacttactgagtgtggaagtcaggtagagtagacatgcacaaactcatgatatatatgccaagtgagtttgtatgatacagtggaaaaaggcctggagttaaggtcaaaagatcaggtttcttatcccagtactagcacttgtaggcgctgtactcttaagcctcattttttttttgtctttttttaatctgtgatcaaggatgaaagatagtacttgctgttgaaaacatcaaataagatgaaatggttttaataatgaaattaatgctgttgtgtgaatactagttattttcatactaaggagcaagaattcattgagtctcaaaacaggttgtgttattctgtatacagtattattttacattaatgctacgagcagtaactgcccattgtgttttctaaaaatcatttaagtgatcttcagtgaaaattataatctccactgaaatgttctgtgtttagcctatcttaggtttttattttctttcttttcaaaagccttaagtacatgtaaaccattttaaaatgcccttttaatcctcctcaaaggacttgctatgcctcagggttgaagttttgcttccttgggtcaagcataacatgattccatatgctagaatcctaatttgaaggagaatataagtttcccaaccttattccctcttctagggtaaataaactacacttcagttcaacagtgtagaacttggtaaatttgagaacaggcctctgtttcccttaagtgataggaactttctgttctctttctctaacttctgtaataacgtggagctgttgttcttttcgtatggtttattctgcaatcctagaaacctttttaaaaacaattctattctgttagaagtcaagagcatagttacccttgggggtgggaggttgtgactgggagagggtagcagaggagtttcagggttcagtagtgttcagcttcttgatgtgggtgctgatatatagttgagttcactttgaaaatttattgagcttgtaggacttaaggtcttctctgtgtatatattatacatattccaataaaatatcccaaaatattgacctcaccttggcattatcctcaacaagtcctccttcagttggaaggtttgttttcttctctgtacttacagtttgaattaatctgctatatattttgttttaattaagtaaacttaggaaaaacctgggtctgctatgttttaaaatgcttatagaaaagaacctgaaaggaagaagggcaaaatcacttattctaagtggtatgattattttgattttttctttatacttgcctatgcttttcaaaatttctgttatgcgtttattacttttgtagtctatgagaaaaatctgtactgtcgtgaaagaagaaataaactgtataaacttggggcttttcataataggatatgaaaatatatttagaaaacatcattataggataacagtttttttcacatttgtactttgttacagatatgctagtctgtatttttgctgtgctattgaggatcaggacaatgaactaattaccctggaaataattcatcgttatgtggaattacttgacaagtatttcggcagtgtgagtagtattttattttaggaaattgaatgccatagtatattttggaaccttttctctaacaagtttattttttggttgtcttggggattctaaccgcgggagagggtgggaatgactatttattagtagaaattattaagttgtccatattgggaacatgcagagcccagtcttatttagcttgtaggaatatgttttcaagtacttgagatttggaaattaagcttacttaaaccagtgatacttagtcatttttagaaagagttaagattgattcactctagttcgattttattcactacctgatagtgaataagcatcttctgcttctgcaagttttaacaattttttcttttcttttttcttttttttttccttttcaggtctgtgaactagatatcatctttaattttgagaaggcttattttattttggatgagtttcttttgggaggggaagttcaggaaacatccaagaaaaatgtccttaaagcaattgagcaggctgatctactgcaggaggtaagctacttattctcttcactaggcactagcatgttttgctcttgctggggaagtctcattcatcattcttacagtttcagaaagtactctgaagcatgcttgtcatgtagtgtccatccatgtgcagtttattgactggaatatgtgtcagtcacgtcaactcagttatctatggatggatggttcagtttggagatggtctatcggtcaggcctcttcccaatggccctttttggaccctaaaacactggagtctaaacctttagaggacagactatttgaagaagggaaaagattggctgaaagtagcagtaagttgagaactctccatctattgcttcaaattgtttaagataaccccctttttcattagtgtagataatcaggagttgactatgagattatgacattttaattccaaattggctcatatttttacctcatgtccattaaatgcaaaagtagccaagcaaatgatagtgttttctaattatactttttgtagaaacttccaggttttttttgttagcaaaactaaacagtatttgcatttctctttgctcttcttaaataacaaaccatgttctgtcaaactgcattcttgtcttacctccatatccccagatgtgtaactcccttttctttctaattaccatagtcatcttgggttaattgtgcagttgatgctgatgtaccttctatttctgaagcttaacatttcatagataaggctacctttttccaaaaacttaatgataccttaattcagataccaaattgaattatgctttagagctaattgtgatttttatcatatggaaagcttacagcatgagaagtgattagtaaatattgaaaaatgaaatgtgttttcactaaagtagttgttaagtgtgtgtttgcatgtatgtaaaagtcttgaatatttttggctcactggttcattttccagaagcattgaaaatatgattttgtatttccagtttattttagtcccttctttgttacatacatgtttatcagtttgttcttgtctttttttagtcaccaaaggtgactttcagtcccattttttagccttggaggcattcagttttaagggagtgaaataaggggagaagagtaacttactttctccattttaacttcttaactcttggactctgtgaggaagggaaagctgtttgagaatctcactgcatcagtcactgactgggacagttgtggggattgcttgaagttgagatgacatcatctggatagacatctactaaatgtgagacaatgcattgtacacttaatgatcttgtagttatcagaagagtggttaaggtgcctgcaaaagtgaagtattagattggcagccctggtgccatctactcttcagtagtgaaatgaacacagaccttttgccttgtgtgtacagtttgccacagtggtttaccaattgattggaaatgttattctggaggtttgtttttaatatcaggtgcgctgactataagcatatactctactgttgtaaaattggtttttaaagttagtatctccttattttgctgttcactaatcagacttttttaaaaattaggtcaaaaccaggattagaaattgggaatttttcatataggtcttcccttgatcactttcatattttgtcacagatctgtattctgctctgtcagaacctggcatttcttccaagtttttctatcattttctgattaattacattggctttaaaatgtatttaaagttattgaagttcaacttttaattttaatatttttcctggagagtaattttttgtttgtttgtttgagatggagtttcgctcttgttgcccaggctggagtgcaatgacacgatcttggctcactgcaacctctgcctcccgggctcaagcgattctcctgcctcagcctcccgagtagctgggattacaggcttgcactaccatgcctggctagttttgtacttttagtagagacagggtttcaccatgttggtcaggctggtctcgaactcctgacctcaaatgatccgtcccccttggcctcccaaagtgctgggattaaaggtgtaagccactgcacccagctgtgcctggatttttaaatgctactgggaaattgctatgggccttagaatatgacagcaatgttaagtttaccttagagcatatattcagtatttaatgtactaggggataagaacattattgcagatccacatttatttgtgtgtgtatatgtacatatgtatatatattcccctatgggagtattttaatagttaatattgtccttctgtttgaagtactatttttatgtctttttttttttttttttgagatggagtttcgcttatcacccaggctggagtgcagtggtgcaatttcggctctctgcaacctccgcttcctgtgttcaagcaatcctcctgcctcagcctcccaagtagctgggactacaggtgcacaccaccatgcccagctaatttttgtatttttagtaaagacaggctttcaccatgttggccaggatggtctcaaactcctgacaggtgatccacccacctcggcctcccaaagtgctgggattacaggcgtaagccaccgcatccagcctatttttatgtctttaattggggaaagtaagtgcaaagagaaaagcataggatgagtatggttggtcccatgtaaaattttccttacccccttgtaacctttgtttaaaataaagaaatgagtactgttaattacagttccttgtctttagaagaaagctgtggtcctgtttctcttctatgactacttttacattgctttgtacacaaacgaaactgagtaccacattgagacattgtctatttagcagtctgagtgaaccatttttcttagccatgtaggtcttggggaagcagtaggtggtggtccattctgaatttagagtgagaatacatcgtaggttaaggccattatgaagccaagctcaagtctgtgtggagcagtaaggcttcaggttattctgttctcttcatcaacatactctgagaagaaatgcaggaatggcaagatgcatgtttcctaaaaatagattcatttatatttttgatgcatgatacaagtttacatctgtgggagagtatttgaatattatgttcataaaatagcaagtggaataagagaaaaagcactccacaaactgctggaaaactttttgttttggataccatgacaacaaaaataattatgatggtaactaacgcttgagtgcttgtatgtgaggccctgggctcagcagtttgctttaagcatcctgtgctaatcctcaagacaccctgtgaaaggttagaggtagcctaatgagaaagtggaatctcagtgaggttccatgactggtctgaggccacctggttagcaactggcaaaaccaggattctaaacccagatctactaggcttcacagctgtgtaaaatcttaaccactgtgcacttcccctaaccccagttatgtattgtcttggtatatatattttaaacgttctgttttagatatgaacttctttgtttctcagtcatatagtgagaaattcataattctcccagaggtttttctgtgtggaaaagagtagatttcctaagacagtgccatctttgacttcttagactgcaaatttttattgtccagattatcagcagttggaattttttattggatatgtagatataaataatatttttcaacctatttcttgttggattgatcaaaatgcctggatttataataacttttttggtcttatagtttggggtatagcattcacttaatcaatttcatgaaatgattttgcttccaaaattgtaaatatagctgtgaagatctaaattcagacttacatttgtagtagaagtcctaattggtcaattttaatctactttttcatgtgtcattatttttctgtttagtgtcaggtcttttacttgaattgattatttctaagcaccaaagatgactttgaacttatcatgtacttatctgttggcttaaaggtgtatacacatctcaatgattttgatttttttttaatttgtgaaatatacatttctatccttaagaatgcttattttcttcagaaaaattaaaaaaaaatttctcttacccaatttgtataaacacatagtttaaggtagtccttcattttatagccaaatagggaagagggtcagtggatacagattttctgttagcatattacagttagtaataaaaatgtaacattaaatgtacattcaaataatagttgctaaaatattagcagatattgtgattagataataaagatatcttttttattttacttcattacttggtaaataaaggattagttttgacatttctagaccaaacttcatgtttattccttttggtgtttggttgtatgaatacataattagatttgggggtaaagcccagaaattggcccgttatccattttttaatgtttggctgtcttaacatgccactggtactaaagatgattcttaaattattaaagtacaacatgctgaaattgctaaattgatattctttgcaatacttggaatacttttccccaccacctattttaagctagatttttggagggatatggtggggggtggtgatgtagttggatttatttaaacacacacatatataatgacaaaggaaataatagtatggctttttttctgtaaagtcaagcacttaccagtttttctctgctccttaattttatagagccagaatgaagaatggggaggtttgtctgaggatatcttatgataaagagcagtctaaggctttagtccctttgatccccaacttatttattggtaactactaaatttaccatttttgtggcatggataaaatggagtgctatgcaaatactgttgcacgtgagatgatttctaagtccttgcttgatccgtgaagatcaaatagttaaatactgggcatttgggctttaacccttagcggttgatgcatgatggtgttgattagtgctttgagatgtgtcaacctttcttttttatactaacagcatcattttgaaatttgtggtgttgtttttcttttgagctttgtttgctgttggtattttttctcactaaagtaatctgtgaaatgcaaaataagtgaggtaccaaaagcaagcataatactcatgaatttgcttttactttgagatgatccactttatgaatagatttactggatttgcagttgtttatctgcctcatctagaaagtggtactctacggaggattagcgctgctaaaattgatttgttttagtgctgggggctgcatgatatatcttagtactatgctatatttttgtgaaagtaataatctgtgggactgcatacaaatggaaaggtaagaatcttaggagaaaagtgatttcttttaaaaaatgaagcttttgtaacttaaaattattttaataagtactttttgaagtattgaataacatatcttttaatatgaagttttggactttttaaaggtcagctcttgatataattaagaatatttgggctgagcacggtggcccaagcttgtaatcccagcactttgggaggccggggcagttggattgcttgagcccagaagttcgagaccagcctgggcaatgtggtgaaaccccatccttacaaaaagtgaaaaaaaaaaagactagctgggcatggtggtgtgtgtctgtagtccaagctaattgggaggctgaggtgagaggattgattgagccctggaggtccaggctatagtgagccatgatcatgctactatataccagcctgggtggccacagaacgaaactttgccgaaaggaaggaaggaaggagggagggagggagggaaaacagaaaaaagaaagaatatttgggcatgctagtccaacttgagaatatcttaaattgttttaaaaaaagagatgcttccaaatatgtacaagaatgtcatttaacagcaaaaagcattttgatataaatcctcttagatttgcttaaataagacaaactcgtgtaactcctttgtaattactactgttcatgttaaaaccttcaagcctcttttaaagttaacaagactatagtcttttattgccagcgtactttagtttttttataggtaaacttaatcagggtttattataacaaattctggacaaatgaagtttgattacattaatgcttgaaatggaagtgcttgaaaggaagggcagaaagcaggacaaatgttgcctttcattttacatttaataagaaacaatttggccaggcatggtggctcacgcctgtaatcccagcactttggaaggctgaggcaagcggatcacttgaggccaggagttcaagaccaacctggccaacatggtaaaaccccatctctacaaaaaatacaaaaattagctgggcgtggtggtgcacacctgtagtcccagatacctggggggctgaggcacaagaatggcttgaacccaggaagcggaggctgcagtgatccgaaatcaggccactgcactccagcctgggcgacagagtgagactctgtctcaaaaataaataaataaataaaataataatttggccagtgtccttactctctggttctcaggttgtagtcattttgctttatgtgtttttgagccttttttcttttcatacttttcaaaattttgaggattttccgcttgctatttctattctattcttttcttaaatgctgatcctgacctagtaatttgatttcatgagccctagggttggaacctgcacagggacctgcaaagggaatagtctgtggtgtcggtggtgattttttttttaattaaaaaatactttctgaaaaatgtcacgtttgagtccttttttcacctactgacattttcttttgtttcctctgagggcctttttttaaaaataaaaattcccattctggaaaaattagcaaatacaggcaaacacactagaatataatcttacccaccaactagagccaattagattaactcagtggttcccatggagtgggagtggtgcagttgtgcccctctaggggacattgggtaatgtttggacacatttttggttgtcacaattgggggtgcagtgctaccggcatccagtaggtgaagaccaaggatgctgctgagaattctgcagtgcacaggacagcccccttagaacgcggaattatctggcctcaaatgtcagttgtgcccaggttaagaagccttggtttaatttaacactatggagtaaagattccatttacatttatagactgctatatcttttcaatattatatgtagaccacagtataaataagtggctaaaaattaatcaaaaatgcaaaaaatcaagaaaggataaatgtgcttaagaacatacaaatagctataaaaatcattcctaggccaggcgcggtggctcacgcctgtaatcccagcactttgggaggccgaggtgggtggatcacaaggtcaggagatcgagaccaacctggacaacatggtgaaaccctgtctctactaaaaatacaaaaattagctgggcgtggtggtgcgtgcctgtaatcccagctacttgggaggctgaggcaggagaatcgcttgaaccagggagtcggaggttgcagtgaagcgagataacgccactgcactctagcctggcgacagagtaagactccgtctcaaaaaaaaaaaaaaaaaaaagtcatctctatgattcaccaaaattacctctacataatgaccagttactggggagataatctatggttgactttagaatccaccctacagcaaggcttgtaggatgtcactctataatttaatttcctcaacaacagccaaatctgttaacttctattaaggtaattgagtttttatgtggaaactgaattgagtataccctgcagacagaacacctttgaattttctgccaatctccccagccactttagggatttgttaatttcttaaaggaggaatagttcaaatgaccagaatttacatatatagacttttgttgcatatatagactttttgttgttgttgttctctggcatcctgttagccttaaaggttttacttagtgaagatatttagtagcatttgagtatttgaaattctgtgattccaagaaatcttttacctttgaaaaaccctaatttagggtattccaaggcaaatacaatacagcatgtcctaaaacatgcttaaaatatttctttgcagtctaaaattatatttgctagctgggcacagtggcacacttccataatcccggctacttggaaggctgaagtggaaggatcccttgagctcagaagtttgagaccagcctgggcaacatagtgagacccctcactcttaaacaaattatatttgctaagttaattattctgcttttttttgtttgtatatttgttttgagacagggtctcactctgtcaccaaggctggaatgcagtggcaccaccatggctcacttgcagccttgaactcctgggctcaagtgatcctcccacctcagcctcccgagtagctgggattacaggtgcacaccaccatgcccagctaattttttaaaaattttcagtagaaatggggtctcgccatgttgtcagggctggtcttgaactccgaggctcatgcagtcctcccaccttggcctcccaaagtgctgggattacaggcgtgagccactgcacctggcctctgcttttttattttaaaagcacaactaactggtagataaagtgatttgtctttagtatttgataactaatgggttttagagtgttatttataagatgtagtaaattatcctcatcattatttttaagacaaatttataagacaagtgtaatagaaatagatcaacagcacaatagaaaaagatggcagaaaacatgaatatgtaattcacagatgaaagcaaaacaaatggtccttttattaagggaatgcaaagttaaaaatcaactagacccttttttgtttgtttcttcttggattggcaaagaggagcacttaaaagctgtattttgttttggaggattagtttggttatgtctactaatgactaaatgtgtacatacattttgacccattagttacacttcaaagaattttatccaacaaaaatgtactgagacacattgcttagtataataagccattgaagcttacccaaatattcatcaatgagaaataggttaagaaaattatagtacaaccatacatgaaactgatgtagctgtaaaagaaatgagatcgatttttttttgtaatgatatggaaggatactcaaagtatatcaagtgagaaaagatctaggaacaggatattattattattattattttattttttgtagggacagggtctcaccatgttgcccaggcttaggagcaggatattagctaactcgtgttacttctgaaaatctttgaagctccccctgctcttttttccagaagtgtaaaaacaagcatgtatttagtattacacatttttaaaaaatgaaaaaatgctgctgtgtgaatgaaagagtatacatcgtgttgctccagatggtaaaactagagtagaatttactaaaataaagtttcagcacgtaaagtaaagcacttctctgctcttggccattttagacactaaccatctggagcaaccatgtaactcttgccactcatagctaacttaatgtaaaaaaaaaaaatcgcttgactttcttagcacttcacaaatgcttgtaagactgacaccaggagccctgtcatctaaaaggcactttatagagtgctttcaattcttctgttttttcattcattgctcaaaatagatcgtagtgagataagatagtctctggccttcttggtctttggcacaaggaagagggttccagagttgagagtaaggactttgcatcctttgccatagaatttgattaggggccataaaaaggaccattgtgttctagaatgtgaaggactaagcataccactttatagtgcaaggaataagtgaagaagtccttttataagaaaaactgcagtagagcaataacttgaaattacacttatttatatttacttttcattaaatgtaaattattttcttttaccacattgtactactagaaagagaatcaggagtttaggcattcagtcatagatattcgataccattgatttacttaagcacttctcatgtcaacaagacttaagcctgcagataattcctattttatcagtgttcgttatagcttccctgttggttttacttgtgagtcataagcctagtatggtgaatatctaggaaatttcacggtaacagggcttgtcttaggttttgagaacaggtgtaacttgacttctctctgctgtttgtcatcctacacttcccactacatctggtcctttttgtagggtgttgagaacaacatttttcttcatgcaggggaaagtggaagtgcatgttttctaagaaggacaaataggaatagaataaaagaaaaagtatattggggctgggcatagtggttcactatgtaatcccagcactttgggaggctgaggcgggtggatcatgaggtcaggagttcgagaccagcctggccaagatggtgaaaccccatctctactaaaaaaaaaaaaaaaatacaaaaattagccgggcacagtggtgggtgcctgtaatcccagctactcaggaagctgaggcaggagaatcgcttgaacccgtgaggtggagattgcagtgagctgagatcaagccactgccttctagcctgggcgacagagcaagactctgtctcaaaaaaaaaaaattatatatatatatatatatatatatatatatatatatatattttggaagggagaatgggagtggaatcaaaaacattggtctcggatgagaagagtctttctcattggttatgtggtgataatggggtaaagctgtagactttttttttctttaattcatgagtaagatgagcaaaattgaggaagtgtcattttcttggccttgagaaatgacatcatctaaaggagaatcgttgggactggggagaaggggaggggtgtatagcttgaggacagtgtgaggagttggcagtagacttggtggggagcaaattagtgaggagcaaaaaagatttcctgggattgaaagcccgtttcaggttgaaataatacattgtcatccttattcaaagaataggtctccagagaacctgtactaaggacaatacatggtttatagttgtacaatacaactggattaaaaaattttttctcactgttttcattctgacctttattcccacttaattgaaatcactggggttttagtgttttaagaaacggatagtttgctgagtattatatgtgactatttcctacgggtgcccaggggaagaacaagatagtaggcctaggcctgcacagggtcccttgtgtgctatgacagactttactctcaccctccctaattcctaattgatataatttttatgtgactcacaagaggtactggtggtaagaggtataaactggaatttataattgaatctactttctttgtatctgaaagaaaaatattttggttaattatgggcatataatttagctaaaaaattaccttaaatgttaagtggtccttaaggcatttataacagaactttttcagaccctagaagtctaaactgggaaattatttaaaacgttattaaagcaatttaaaatggtaaaaataatacatttatttttgtgcattttagagtttcttttcttcttgaaggatgtttttccagtgaagaggggtttctccctatgaagagtattctcacatttaatagatggtaatttcttacttaagtacagtaatatggatcaatggctataaagaatagtttggcttatcatcaacccttttctttcctaaaagcagtaaaaggtgtgtcagggtataagtggtggaaatgcctgggtggtcacattgagaattgttcctgtagaattgctggtgtagttcatagtaagtctcctggggaggaatggttgcatactccgccctgtttgggaaaccacctcttctcttttaatgagcgtaagctctcgatggttggtttttacatggtatgatagaaaattaagagagaaaagaaaaagatgataaactataatataaaggctcaaagaactggtattatttaggcaaaaggttatttgacagattggtattatttaggcaaaaggttatttgacagacttaaacttttcttgttctctctccagaaaacagagactatgtatcacagcaagagtttcattgggtttaagaaagcgtactagaatacgtgctggagtactgacatgcatcaaaatgtagtaggatatataaattcagtttgtaatgacaattttgtcaagtttgttatttatattttagcattacctgaaaagtctaattacattaaatcccaagggatagtcccaattacttcattaaactggtattttcatagggaattttgcttggataatgatccattattggggcttataatttattttttacacagaatatggaaatagcttcagaggttcattgacaataaagcattcattaaatactgtgaatcactaatgccattgatacagaagaatttccctatgaaaatgagagcttctgtgagaaaatgaagtagttgggagtttaatttcttattaatatgattttaacttgctgcttcattccactatattctgagttgggggaaaagggcagctatctctttaaaatatttaggaattctttgaggattaaaatgtaactggcttttgtcctcagatacgtttgtaattaatggttgtgtaagtttagggatttgttagatatttttcttggaacagtttacatgattttgtagttcaacatttcaaagtttcaacttgaataaatattaaaatgaggatactttaaagacactcaaataagcaattttaaacttgctttctggtggggatataatccctttgagagtctgaaggatgatgggctgtcaccccaggaaaatttgcacatcattttgtttctaatttcagggaactctcagagcccctagaagtccttctgtagacactcaaatctggagagttcgttaaaatctgtcttgaggatttttaaaaaagtaatatcctcagtctcagtcaaattctttggattttttgcttttgt

SEQ ID NO: 5509 - DNA, 14269 bp, human
cctatgccagccgggtgtcctccccacagcaccacggcttctcttcctcagcacggcgacaggggcttccccttcgccgccgccgccgccgccggccaagctccgccgcgcccgcggcccgcggccgccgtaagtccctgggggcgaaagggggcgccggggatgggggagagggggagggaggactgggcgcgccccccgccaccccgcgcgcgccccgacgaccccaccccgagcctgcccggcccgccactgggtcgccgcgcccgcaactcacttctctccgtgtccgcgccctccgcaccactccgcgccgcgcccggggatgtgggggccagtcccgggctccgcgacagcctcgcggcacctgtggttcgggaatcgcctcaagttttgcggggcgctttcgggaggggccgggggcggtggcggccgaggactcttggcgccccctgcgcggcggcggatgccattgtctgctccgctccttgcctgtcacctctcccgggcttggtcagtgatggagtgtggccacgggagtgggggggaggcaccggcgacggccggacccgaggaacgctggccccgagcccgcgccgcggctgagcccattgtttttaatgccagtctcgaggaattgtggtgccctgtgatttgcggcaaaatcaaagcgttggtttttaacacgagggaaggaatactcgtgctttgcaaccgggtttcgtcccatgttaggacataatttattttaaggagaatacattgttttttcgtcctgcaaagtggtagggcggatacaggaccctgctccagacagccttgagcccatactcttcgcaggcaaaccctcaccctttctggtcaccaagatctaggaatacgaggtccattcttttccaagttctggtaacgggtttgcagtaaatgcccagttgatgcttcacttcctgcccccttcgaatgccgctatcttcaggacttgcacgggaggcactttggtatcacctaataatgtccttatattttgttcccctgacgcattttaagtgaggtaataagaccattttaactttactaaagttgaattgccacgtcatacatttctagatatcttgttgatacctttttgggtggttacaaaaagcgacgataatttcttaccgaaatttagggcccatttttattctacattggttctgtaaatttcccctccccgtgttcaaattcaagatggtgtggtgaatcttgagaatcatgcttgaatcttatttgcagtaacgctgttaaaggaacttaacagtgattaaaagaaaaaaggatacctatgtgaattctgcctttaaattacctttgtagaaacaatacttctgtttgcagttgagatgaccaattggattacaaaaagcttggcgttaaaaatgaaacatgcagactaatcaacacatttgcagatcacaaataaatacatacaaattagtttaagtataaaacacactagaattcagcatccattccatctgtagatactattttttattttaaatgaagtatttcatgtaatgtttcaatgctgaatcttatttaataagtgtaaatcttattgtggccttttaaacgtttgttttctttttcataatacattaactcagttctagattttgtacatatttaagttggaatgctttaaaagtcagatgaaaacatacttttttattaatgaaaatttgtatttatgggatttttcagttaatattttggatcattctgttttgcttaaaatatgccatcataaactgaggagaacattccaagacataagctactgtctgcaagtaattcaccctggaactagaacggcctcaggatgaaaaatagcaggtcttctgtttctttcaaaagtacccaaaccagatgatgtctaccattctcttttgatgcatatagagagtgcgcaatgtatagcacaggtagaaaatagtttcttaaattgaaagagtgatctttatttttcttcaaaaatttcacttcagcttattacccatttttcttttttctcctgcacactccccttcaaacttaatgtggaacaaggtgggattggaaggtttgcatctagaggaagatctgtccaaaagaatttcttgctattttaattggcatagaaatattgatggctactaatcatttgtcatgtaaatgccccatcccccaaaacttctctgtgaaacacataatcttaactttattgattcaaagtattacatgtaatcttgattttatttatcttaacagatgcagtttatgttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaaggtataatttttgtttgtcagaaaggtgaaatagaatcaaatgttaggtcatttaggaaattgcagacttcagtgatgacatttataaataacgattaataaagatttagatgaaataggtttaaggtaaagctttgtgtttttaaaataactagtgttttgattgataattactgaggctgaaatgataaaggcagggaaatcctttgaaaactagttatataattaaaggcataaatgattattcatgcttaatcatctttatagaagagtttaatgaattcatttcattgcaggggaaagtagggtcagtattttaaattgtgtgagtaattctctgaattgagacaagtacagatagagtctaattctttttccccgaaaatctataaagtaatgactaatatttgacatgccttttatctgatttttagaatcttactcacgtgtaaataccttgactatgtagactatttcaatcacatagatgttttaaaaactttgtgtatacatgagatgtgtttgtaagtagtgtttattaacttttaagtacccttgttgctatggtgggggtgcaattaaatatgacagataatttttccaaggacagattttttaaaaatttgatgttacaaaatgactcatagattggcttttaacactaaaatttttttaatgctatacgtctttattttataaatatctgaaaccctgaataccctaaaataaatttctcaagattgttctaagtaggttaaaagaaataaactttcttcttttacagaacattttttgaggggacatttacttcattccccatttgtttctttttgaataatttgctgaatttaagataagagcatttctgcatataaaaagttctcttgtgtggggagtatacatggaagtaacagtatgggatacaatgagggtgggagagaagtctggttttcttctcagcttccctttattgcactccaaatatgggttggatattttgtcagggagatggctgggaagaaatggagattacaagacataagtttcttaaatactgaggactcctctttattattgaatgatctttggtgattttgtatctttgggtgattttgtatccagtgtttcgtttggtcttattaaagattatagaaaagtcatatcatttgagaggtgagagatgttttacagtgatctagtcaggtgattttgttttgttttgttttgttttaagctttttgccccatgggtagaaccttaaataaaatgagtggaagtgaggctgctccttgtgaaatcaggaatgaggatcctgtatcctggctcacttggcctttacccctctgcacaggagacagttcttgagtttgaaaactgccgttgttgatcaaacttcaattttataaagaatgcaaatttgggagaagtgacttgtctagggccatatgccagttagtgattgacatggggctgcaactcagatcttaagcttagaggcaaagattttaaacagggctggaaaaagatcaggtttacatatcttaaaagattgaactgagacaatggatgagggcaggaggggctgagactggcacctgcaggatcagtaggagactatgtgagatcctgaacccaggcgctagaaaggagggctgtcactaaatagccattatcaaataggtaggtttgataagacttggtcacctctagaagtgggaagaatatgggaggtcgaggcaggagaatcgcttgagcccaggagttcaagtccagccctggcaacttagtgagaccccgccgtctctacaattaaaaaaaaaaaaaaaaattagctgggcgtggtggcatgcacctgtattcctagctgctctggaggctgaggtgggaggattgattgtgcctgggagttcaagcctgcactgagccctgattgggccactgcactccagcctaggtgacagagtgagaccctcaacgacaacaacaaagcggagagagcagcgaaggaaagggaggagtggggtgatctccacatttctggtttgctgatggggtacaaggtgagctagataactcggcttattttggggtgagttgatttggggatgtctatgtgactttcattaagagaagcctgattttctggtgggatgtggttggtgtaagtatggaagtctggggaaaataagacaaagtattagatcaccagcattcaagtggcaggcaaaggagatgaagaagggaccttcagagtggaatgagaaatttcaccaatgccagatgttgcataaagttcaatgaaagtgaggaaggaatctggtagattttacagtgagcatttcatataatgccctttgccagaacattttcagtggaatagtggagatagaactctcgatgtaatggggcgaagtgtgaagaggtggagaaatttaaatagcatgtgtagactattttggggaactttgctgtgaaggacaggagacgaggtggtaaccactcatagacataggagtgggggacaaggtttttaaaaaagaaggtgtgagaggcttaagcttatttctagataggggaaggagtcccccgtgtggaggaggaaaataccagcaagggattcaatcccaggaatgggctgttatgggaagaaaggaaagcactgcttggtgttcatgcacatgtcactcagtctgtccgtgttgagccactactttttcttttgaaagctacaaagggtatctaatccaactctgatacttatatcaagcacctttaaataaaaggtggactttaaaaaaaacagctttattgagatatcagtcatatacaaaaggtggaatttatcagttctttctctatacgttcccccttccatttcatactgaaaacctcatctactctaccacttacggacatattttttgttggtataaacaggtggtttgttttccctactgctggaagcgaagagctttttaagcaggagaattactgcttagcgcctgagaaattctggactgggacttctgctgttcatatcagcaagtgatttttgttgtttttgttaaattatctcatctacattcttcatcctgagtatttggcatacaaattcccccttttgagaggggaatgatggataagaataatattagctgaaaagacagactgaaaatctggggacttaagttctgttccctttgtaacgttagctagttttatgactttaaacaagtcactttgtttccttatctctaaatgctcttgaagatcccttcaagacagaatactgtgcttttttgattcctgttttgtgtagcattttgtggaagagtcactggattaaggtcttttaaaattaatttaaaaacatatatatctccaaattactagcttgataatttgttaaagaatacttactgattttctttactaacaaaagaatttttaatgacataccagtgggtattgagaacacttcagctacattcacccacagtcagctgatatttagctgatatttagctgactgcggagaagtcatgtgttttgaatataagaataggcactttcagatgttctctgagtgccagtaattagagtaagccttaatccactgtgctaaaaataaccaaacatacctttcttcttactagtctattattaattttacttcagatttagacttacaaataggcactaagagaacaaaatgagctcattattgatttttttaaaaccatttggtcctaaatataggaagtacacttcaggttctcttggtaatcttttactaaatcagtatggcatattttacttctcttcaaagctcttaaaatattgtttcgagcacattttaatttttgccaggtatgggattacgttaatgcaattgctggctatagtttttaatgtaaaacttgggctctagagtcaaattgctgttcctaggcaggttactcaaacctgggtctcttatcaatgcaaataataatggtatctcatggatacggttgttgtgaggattagagtggtaaaatatgcaaaagccttagctaacatttaatgtctcatgtagggcgaggattcagtgaatggtacttaattattatgtttctgtttttttcctgccctaagctttctggaaagaggtacattattatcctgatagctatctgttcacctacaccaaagaattcattaatttgattattctttttccattccgagtgaaagtaaacattactggctggggcttagacacattgtttctgatgatttttaaattaatgcttccaagtgattcatgcagtttaggacctttgactagtgtttaagtgctttttatttgtaagtaaagaggcagtactgtggataaggagcgaggatggtacgagcattagcttgtttaatagtagcatgaggaaatcttaaataaaaggaattttacttgaaactgttagtaaactttgtataataaattatttagcattctgttcctatcagctagtcatatctggtttttaatctaccatttttatgtcagtccctttaatgtttagttttcttaaatcagggaatcttatgtgtcatttatcagtttcctcaaattcaaagttctatttaatgagcatgggttagggaggatggagagttggaatactctattctcttttaaatagacaaacaaaaacagtaacgatgggaaagagagggagcactttgttaaagttggcattgatgccctgttttgtcttccatgacttattcccttcacaatgatgataaatgaacacatgtgaatacctcctctcaataagactgcagtagctccaccattttaaataacttactgagtgtggaagtcaggtagagtagacatgcacaaactcatgatatatatgccaagtgagtttgtatgatacagtggaaaaaggcctggagttaaggtcaaaagatcaggtttcttatcccagtactagcacttgtaggcgctgtactcttaagcctcattttttttttgtctttttttaatctgtgatcaaggatgaaagatagtacttgctgttgaaaacatcaaataagatgaaatggttttaataatgaaattaatgctgttgtgtgaatactagttattttcatactaaggagcaagaattcattgagtctcaaaacaggttgtgttattctgtatacagtattattttacattaatgctacgagcagtaactgcccattgtgttttctaaaaatcatttaagtgatcttcagtgaaaattataatctccactgaaatgttctgtgtttagcctatcttaggtttttattttctttcttttcaaaagccttaagtacatgtaaaccattttaaaatgcccttttaatcctcctcaaaggacttgctatgcctcagggttgaagttttgcttccttgggtcaagcataacatgattccatatgctagaatcctaatttgaaggagaatataagtttcccaaccttattccctcttctagggtaaataaactacacttcagttcaacagtgtagaacttggtaaatttgagaacaggcctctgtttcccttaagtgataggaactttctgttctctttctctaacttctgtaataacgtggagctgttgttcttttcgtatggtttattctgcaatcctagaaacctttttaaaaacaattctattctgttagaagtcaagagcatagttacccttgggggtgggaggttgtgactgggagagggtagcagaggagtttcagggttcagtagtgttcagcttcttgatgtgggtgctgatatatagttgagttcactttgaaaatttattgagcttgtaggacttaaggtcttctctgtgtatatattatacatattccaataaaatatcccaaaatattgacctcaccttggcattatcctcaacaagtcctccttcagttggaaggtttgttttcttctctgtacttacagtttgaattaatctgctatatattttgttttaattaagtaaacttaggaaaaacctgggtctgctatgttttaaaatgcttatagaaaagaacctgaaaggaagaagggcaaaatcacttattctaagtggtatgattattttgattttttctttatacttgcctatgcttttcaaaatttctgttatgcgtttattacttttgtagtctatgagaaaaatctgtactgtcgtgaaagaagaaataaactgtataaacttggggcttttcataataggatatgaaaatatatttagaaaacatcattataggataacagtttttttcacatttgtactttgttacagatatgctagtctgtatttttgctgtgctattgaggatcaggacaatgaactaattaccctggaaataattcatcgttatgtggaattacttgacaagtatttcggcagtgtgagtagtattttattttaggaaattgaatgccatagtatattttggaaccttttctctaacaagtttattttttggttgtcttggggattctaaccgcgggagagggtgggaatgactatttattagtagaaattattaagttgtccatattgggaacatgcagagcccagtcttatttagcttgtaggaatatgttttcaagtacttgagatttggaaattaagcttacttaaaccagtgatacttagtcatttttagaaagagttaagattgattcactctagttcgattttattcactacctgatagtgaataagcatcttctgcttctgcaagttttaacaattttttcttttcttttttcttttttttttccttttcaggtctgtgaactagatatcatctttaattttgagaaggcttattttattttggatgagtttcttttgggaggggaagttcaggaaacatccaagaaaaatgtccttaaagcaattgagcaggctgatctactgcaggaggtaagctacttattctcttcactaggcactagcatgttttgctcttgctggggaagtctcattcatcattcttacagtttcagaaagtactctgaagcatgcttgtcatgtagtgtccatccatgtgcagtttattgactggaatatgtgtcagtcacgtcaactcagttatctatggatggatggttcagtttggagatggtctatcggtcaggcctcttcccaatggccctttttggaccctaaaacactggagtctaaacctttagaggacagactatttgaagaagggaaaagattggctgaaagtagcagtaagttgagaactctccatctattgcttcaaattgtttaagataaccccctttttcattagtgtagataatcaggagttgactatgagattatgacattttaattccaaattggctcatatttttacctcatgtccattaaatgcaaaagtagccaagcaaatgatagtgttttctaattatactttttgtagaaacttccaggttttttttgttagcaaaactaaacagtatttgcatttctctttgctcttcttaaataacaaaccatgttctgtcaaactgcattcttgtcttacctccatatccccagatgtgtaactcccttttctttctaattaccatagtcatcttgggttaattgtgcagttgatgctgatgtaccttctatttctgaagcttaacatttcatagataaggctacctttttccaaaaacttaatgataccttaattcagataccaaattgaattatgctttagagctaattgtgatttttatcatatggaaagcttacagcatgagaagtgattagtaaatattgaaaaatgaaatgtgttttcactaaagtagttgttaagtgtgtgtttgcatgtatgtaaaagtcttgaatatttttggctcactggttcattttccagaagcattgaaaatatgattttgtatttccagtttattttagtcccttctttgttacatacatgtttatcagtttgttcttgtctttttttagtcaccaaaggtgactttcagtcccattttttagccttggaggcattcagttttaagggagtgaaataaggggagaagagtaacttactttctccattttaacttcttaactcttggactctgtgaggaagggaaagctgtttgagaatctcactgcatcagtcactgactgggacagttgtggggattgcttgaagttgagatgacatcatctggatagacatctactaaatgtgagacaatgcattgtacacttaatgatcttgtagttatcagaagagtggttaaggtgcctgcaaaagtgaagtattagattggcagccctggtgccatctactcttcagtagtgaaatgaacacagaccttttgccttgtgtgtacagtttgccacagtggtttaccaattgattggaaatgttattctggaggtttgtttttaatatcaggtgcgctgactataagcatatactctactgttgtaaaattggtttttaaagttagtatctccttattttgctgttcactaatcagacttttttaaaaattaggtcaaaaccaggattagaaattgggaatttttcatataggtcttcccttgatcactttcatattttgtcacagatctgtattctgctctgtcagaacctggcatttcttccaagtttttctatcattttctgattaattacattggctttaaaatgtatttaaagttattgaagttcaacttttaattttaatatttttcctggagagtaattttttgtttgtttgtttgagatggagtttcgctcttgttgcccaggctggagtgcaatgacacgatcttggctcactgcaacctctgcctcccgggctcaagcgattctcctgcctcagcctcccgagtagctgggattacaggcttgcactaccatgcctggctagttttgtacttttagtagagacagggtttcaccatgttggtcaggctggtctcgaactcctgacctcaaatgatccgtcccccttggcctcccaaagtgctgggattaaaggtgtaagccactgcacccagctgtgcctggatttttaaatgctactgggaaattgctatgggccttagaatatgacagcaatgttaagtttaccttagagcatatattcagtatttaatgtactaggggataagaacattattgcagatccacatttatttgtgtgtgtatatgtacatatgtatatatattcccctatgggagtattttaatagttaatattgtccttctgtttgaagtactatttttatgtctttttttttttttttttgagatggagtttcgcttatcacccaggctggagtgcagtggtgcaatttcggctctctgcaacctccgcttcctgtgttcaagcaatcctcctgcctcagcctcccaagtagctgggactacaggtgcacaccaccatgcccagctaatttttgtatttttagtaaagacaggctttcaccatgttggccaggatggtctcaaactcctgacaggtgatccacccacctcggcctcccaaagtgctgggattacaggcgtaagccaccgcatccagcctatttttatgtctttaattggggaaagtaagtgcaaagagaaaagcataggatgagtatggttggtcccatgtaaaattttccttacccccttgtaacctttgtttaaaataaagaaatgagtactgttaattacagttccttgtctttagaagaaagctgtggtcctgtttctcttctatgactacttttacattgctttgtacacaaacgaaactgagtaccacattgagacattgtctatttagcagtctgagtgaaccatttttcttagccatgtaggtcttggggaagcagtaggtggtggtccattctgaatttagagtgagaatacatcgtaggttaaggccattatgaagccaagctcaagtctgtgtggagcagtaaggcttcaggttattctgttctcttcatcaacatactctgagaagaaatgcaggaatggcaagatgcatgtttcctaaaaatagattcatttatatttttgatgcatgatacaagtttacatctgtgggagagtatttgaatattatgttcataaaatagcaagtggaataagagaaaaagcactccacaaactgctggaaaactttttgttttggataccatgacaacaaaaataattatgatggtaactaacgcttgagtgcttgtatgtgaggccctgggctcagcagtttgctttaagcatcctgtgctaatcctcaagacaccctgtgaaaggttagaggtagcctaatgagaaagtggaatctcagtgaggttccatgactggtctgaggccacctggttagcaactggcaaaaccaggattctaaacccagatctactaggcttcacagctgtgtaaaatcttaaccactgtgcacttcccctaaccccagttatgtattgtcttggtatatatattttaaacgttctgttttagatatgaacttctttgtttctcagtcatatagtgagaaattcataattctcccagaggtttttctgtgtggaaaagagtagatttcctaagacagtgccatctttgacttcttagactgcaaatttttattgtccagattatcagcagttggaattttttattggatatgtagatataaataatatttttcaacctatttcttgttggattgatcaaaatgcctggatttataataacttttttggtcttatagtttggggtatagcattcacttaatcaatttcatgaaatgattttgcttccaaaattgtaaatatagctgtgaagatctaaattcagacttacatttgtagtagaagtcctaattggtcaattttaatctactttttcatgtgtcattatttttctgtttagtgtcaggtcttttacttgaattgattatttctaagcaccaaagatgactttgaacttatcatgtacttatctgttggcttaaaggtgtatacacatctcaatgattttgatttttttttaatttgtgaaatatacatttctatccttaagaatgcttattttcttcagaaaaattaaaaaaaaatttctcttacccaatttgtataaacacatagtttaaggtagtccttcattttatagccaaatagggaagagggtcagtggatacagattttctgttagcatattacagttagtaataaaaatgtaacattaaatgtacattcaaataatagttgctaaaatattagcagatattgtgattagataataaagatatcttttttattttacttcattacttggtaaataaaggattagttttgacatttctagaccaaacttcatgtttattccttttggtgtttggttgtatgaatacataattagatttgggggtaaagcccagaaattggcccgttatccattttttaatgtttggctgtcttaacatgccactggtactaaagatgattcttaaattattaaagtacaacatgctgaaattgctaaattgatattctttgcaatacttggaatacttttccccaccacctattttaagctagatttttggagggatatggtggggggtggtgatgtagttggatttatttaaacacacacatatataatgacaaaggaaataatagtatggctttttttctgtaaagtcaagcacttaccagtttttctctgctccttaattttatagagccagaatgaagaatggggaggtttgtctgaggatatcttatg

SEQ ID NO: 5510 - DNA, 124214 bp, human
tcctttgtccgctctctgatggcgccggctccctgcccagcgctgagtcgggtccggccgccagccccgcgctcgcagacctcggctgccgggtgtggcgcggggactggggaacgctggcccgtgcccagtgcggttggagcctgtcccgcgcgtccccgggacgcgcttcttcccgcctccgcccgcgccagcgcccgcacccggatccccacttctcccggccctcgggagccaggagagccctgagatggcgttggcggaagtgaagccccgagcgggggtctgcgaggctggtgatcagcgccggtaacatggcctttctgtcctctccccggtcccagtgcaccccttaaacaacgacccccgcgttttccccgtactagatggttagggcgcatagtgccgaactacgctgctgctacagaatagcttttttgggggcaacataaaaaagaattgtatgtatggtttatatacaacaaaatgtcccattttcagtgtgcaaatcgacgggatttgacaaattatacactcctgtaaccattatcccaaagtgaacattgaccatttccttcaccctgcaaagttccctggtacctcctttctgtcaatccaccccaggccccgcactcaaccccggttctgattgttatcatagcttagctttgactgttctagaacttcatagaacaagatcatcaggtaagtactcttttgtgtctaacattactttttaaatggccatcactgagaaggtgtctctgggtgcttccggtgcttttatttgctctaggcctgcctggtctaatgtgggagccactggtcacatgtggttattgaatactggaaatgtggcaaaatccgtactgagatgtgctctgagtacaggcacctgatttctgaaagcttagtacacaaaaaagatgtcaaatatctcactaatacattcttacattgtgcgttaaaagtgataacatttttggctacattgggttaaataacatatattaacatgaacttcatttgattctttttacttttttaatatggctactagaaacttaaaattacgtacctggctgtgtaatattttttattaggtagtggagacagcacagctctacactgtgctatcctataaacacttggttctgctcactgcatgtaagagtaaatgaaaaacttgtcttgacaccagaaacaatcctcaatggaggaagtgatctaaaacagggccagcctttccctgaacctttgaaactttgttaaacttacttgtgtgcttaaaagaagtagagggccgggcatggtggctcatgcctgtaatcccagcactttgggaggccgaggtgggcggatcacgaggtcaagagatcaagaccatcctggacaacatggtgaaaccctgtctctactaaagatacaaaaattagctgggaatggtggcatgcacctgtagtcccagctacttgggaggctgaggcaggagaattgcttgaacccgggaggcggaggttgcagtgagcccagatcgtgtcattgcactccagcctggtgacagagcgcgactccaactcaaaacaacaacaacaacaacaaagtaggaagaattaggtgtccccttggtattaagttgcatttttacaaaaggtctctaaaatatccaaggtgctttaaaaaggtatcttgtgtttttgaaaaaacagaaaatgagcaattgcttatgtaggggaggaaagagctgatatcataagggtcacggctgacagccttaaacaagagacagattaacaagagagaagcataataatttattgaatcataggtttatgtgacatgggagccttcagaaatgaaaaccccttaaagatgcaagggaaatgatctgattttatgcttggagtccatgaagcagggacagatgagctaatggaaatagactgagtggggaaacccagcaaagcctgtccacattcttcttggcctctctgttgtagcgtttcttcctccccagtatggggtaggacctctttggaatgagggtcttaatttctttatggccagctgttgtatagaaaggtggttgagaggaaggttagagtcatattttttggctttatggctggctttggggggaaaagggttctagtttctatgacttgccttgggggagtatgaggggtgagagacaggagggcaggagaaggtcagagagaaactttgcttctgaggccttcatttttgggttttgttttctgagccccaacacatacaacctaatcacctaaatatattaagacataacatggtgtatctttgaccaaattaagatagaaatctgtttttttttttttttttttttttttggagacagagtctcactctgtcaccagggtagagtgcaatggcacgatcttggctcattgcaaccttcacctcctgggttcaagtgattctcctgcctcagcctcccgagtacctgagactacaggtgggtgccaccacgcctggctaatttttgtatttttagtagagacaaggtttaaccatgttggccaggatggtcttgatttcttgaccttgtgatccgcccgccttggcctcccaaagtgttgggattacaggcgtgagccattgcacccggccataagatggaaatcttagtggtgacaaataaaatttagatcttagtttaaaaaaacatagtcaataatatattcaattttatagtctgctctctttttcaggtaacataagcattttctttcttcctttttttttttttttgagacacggttttactttgttgcccaggttggagggcactggcacaatcttggctcactgcaacctccacctcccaggttcaagcaattctcgtgcctcagcctcctgagtagccgggattacaggtgcacgccaccacacctggctgattttttgtattttagtagagatggggtttccccatgttgcccaggctggtctcgaactcctgagctcaggcaatccgcccgtcttggcctcccaaagtgctgggattacaggcgtgagccaccgtgcccggccacataagcattttctttttttttaacttttttttttgagacgaagtctcgctcttgtcccccaggctggagtgcaatggtgctatctgggttcactacaacctctgcctcccgggttcaagcgattctcctgcctcagcctcccaagtagctgggattacaggcgcctgccaccacgcctggctaatttttgtatttttagtagagacagggtttcaccatgttggccaggctggtctcgaactcctgacctcaggtgatccgcctgcctcagcctcccaaagaagcattttcttatacaaaaatttattaggcataatgtgacttgtacgaatgtatgccagttttcttcaccatacctctacggcatttttccatttcggtaacttttacaaagagagtcatttgaacagtataacagtgccagaataaggtataattaaagcacagtttatttgccccttaatcctgcaggaaaggtgaagtccagtggaacatagaccttgtctttttgtttatctccatattcctaggacttggaaatatgtcaagcatgtaatagatgttcaaataaacattatatatgtaatatatgtatatatataatttatttatttatttatttcagacggagtctcactctgttgtccagactggagtgcaatggtgtgatcttggctctgggtttggattgacaatgttttaagctataaacataggtcagataggtgggtgccctggtgactagtgaagatgtgcgatggcattgaatgtgatcaactgtgttgtgtagagaaaggtaggcccagggacttagggaggccatctgggatggaacatgtatattttgaatagcttcagtttactcagcctgaccatggtcagctagttcaaatggaattcacagctctgacgtgtgataactttagttaagatagtttgttttgaaaggtaagcagaggaaaccacaaaatcagaatgggcattcctttgaggaggacaaataagaagtgggtaactgaaattgttcctacccgaatgcatttgtgctgaatttccaagtatgtaaaaaaattgtgaaattacaaatgaaagtgaaatttatagttattaccttttgttagttactgtctctctctctctctctttttattttttcttttttggtaccgagtctcaccctattgtccaggctggaatgcagtggtgtgatctcagctcactgcaacctccgcctcccggcttcaagtgattctcctgcctcagcctcccatgcagctcatgtagctgggaccacaggcacacgccaccacgcccggctactttttatatttttagtagagacattgtttcgccacgctgaccaggatggtcttgaactcctgacctcaggtgatccgcccgccttggcctcccaaagtgctgagattacaggcatgagccaccgcacctggtctctctttttatttttgagacaggatcttgctttgtcacccaggctggagtgcagtggcacaatcacttggctaactgcagccttgacctcctgggctcaagcaatcctcctgcctcagcctccccagtagctgggactacaggtgtgtgccaccacacctggctaatgttttatttttcttttgtagagagggagtctcactatgttgaccaggttggtgtcgaacttctgacctcaagagatcctcccacctcagccttccaaagtgttgggattacagatgtgagccaccatgcctggcattatttttctttttctgtaactgtaattttatattgtggtcttactcagttgcccatttgcctgccatgagtacacaaataatactgtttatggtctactttcacatacatggtgaaattacaagagcagaaggcccctgtacacactcaagggaaaaacaatagtactcaaagtaaagaaaatcaagttattgggcttcctataaaacaaaagggtttgaatcagaaagcagcagaaaagtcaaataaattttccttatgactgtcaacttaaaaatcacaagatctataaatttagaaaggagactttcttttttaaaacattttcttttctttttttttttttgagacagagtctcactctgttgcccaggctggagtgcagtggcgtgatctcagctcactgcaacctccgcctcccaggttcaagtgattctcctgcctcagcctcccgagtagctgggattacaggcgcatactaccatgctcggctaatttttgtttgtttgtttgtttgttttttttttgagacagagtttcgctcttgtcacccagactggagtgcaatggtgcgatctcagctcactgcaacctcctccacccaggttcaagcaattatcctgcctgagcctcctgagtacctgggattacaagtgcccacaaccacgcccggctaatttttgtatttttagtagagatgggatttcaccatgttcgccaggctggtcttaaactgctgacctcaggtgatccacccgccttggcctcccaaagtgctgggattacaggtgtgagccactatgcccagcctaacttttgtattttttagtagagacagggtttcatcatgttggccaggctggtctcaaactcctgacctcaggtgttccgcctgcctcagccttccaaagtgctgggattacaggcatgagccattgcacctggccaaaatttttcttacctttcgagtcggagtctcactctgttgcccagaccggagtgcagtggcacgatctgggctcactgcaacctctgcctcccaggttcaagtgattctcgtgcttcagccccgcaagtagctgggattacaggtgcctgccaccacacctggctaattttttatttttagtagagacagggtttcaccatgttggccaggctggtctcgaactcctgatcttaagtgatctgcctgcattggctgcccaaagtgctgggattataggcgtgagccactgtgcctggtgactttatttcttttcttttctttctttctttttttttttttgaggcagagtcttgctctgtcacccaggctggagtgcagtggcacaatctcggctcactgcaacttccgcctcctgggttcaagccattctcctgcctcagcctccctagtagccaggattacaggtgtgcaccaccacacccagctaatttttgtatttttagtagagacagggtttcaccatgttggtgaggctggtctctaactcctgacctcgtgatccacctgcctcggcctcccaaagtgctgggattacaggggtgagccaccacgcctggtttactttatttctttgcaggctgtaacagcctgcaaaggggccatcccacaggctgggaagcacacgttttaaagagacagggtctcgctatgttgcccaggctgttctcaaacttctggcctcaagtgaccctcctaccttggcctcccaaaaccagaggcaggcactctgaaggagggttcagttttatgctgaatgggttggctaaatatacatattcaacaggttacaggaggagctatgaatattcatgaaggtggtcctgactcatgtgtattgaataaacatgaaaatagcatatgacccctgttcactttggggatggagacttaacatttaaatgaatttcagttaagccctatgcatcaaaagatctttccaggacatgaaggcacgcaagtccacagcctctgtaaactggccagagccagtccatggttggtggtcttatcaggagaaagttactcaaatcagtctcttgtccaataaaagctgtagttttgactggtgtaacaggactcagtcagtcagcatctgtgagctagatgagttgtaattattttaatattgcttatttaaaaacagtttttattttttatttttttgagacagagtctcgctctgttgcccaggctggagtgcagtgagccactgcacctggcaagacttttttttttagagtaattttaggctcacagcaaaactcagtggaaagtacagagttcccatacaccctctcccccactgctatgcccagcctccctgactattaacatcctgcacctgcagagtggtacatttgttataatcagtgaacctacattgacgcatcatttttgcctaaagatcataggtttttgttttgtttttttgagacggagtttcgctctcattgcccaggctggagtgcaatggcctgatctcggctcactgcaacctctgcctcccaggttcaagcgattctctcttcctcagccttcggagtagctgagattacaggcatgcaccaccacacctggctaattttgtatttttagtagagacggggtttctccatgttggtcaggctggtcttgacctcccgacctcaggtgatctgcccgcctcagcctcccaaagtgctgggattacaggtgtgagccaccgtgcccggcggaaagtctgtagtttatttacatcagggttcgctcttcctgttgtccattctgtgggtttggataaatgtgtaatgacatgtatccatcattacagtattatacagaatagtttcactgccctaaaattcctttgtattgtgactattcatccctctctccctcctacccgctgacaaccactgatctttttactatctctctagttttgctttttctaaaatgtcatatagttgaagtcatacagtatgtatgtttttcagattggcttctttcacttggtaatatgcacttgagattcctccatgttttttcatggcttggtagcccatttttttttaacaccaaattatattcctagagattgttgtatattttccactttacagatgaaggaataggcacagaaaggataaataacttgcccaaggccgggcgtggtagctcacgcctgtgatcccagcacttggggaggccgaggtgggtggtcacttgagaccaggagttcgagaccagcctggccaacatggtgaaatcccatctctactaaaaatacaaaacttagcccagcatggtggtgcatgcccgtaatcccagctacttgggaggctgaggcatgagaatcatttggaccggggaggtggaggttgcaatgagccgagattgtgtcactatactccagcctgggcaacagagtgagaccctgtctaaaaaaaaagaaaaaaaaaaaaaaaagaacttgcccaggtacagtttgtacagatcagtctgacactggagtctgagctcttaaacattttagcatgcctgtgaatcctagagaaatttggtttatcatgatgaagtttgttgcatgatagagttgaggtctttggaaacccagggcaacagacctaggcactttgcttgcagaaggtatctacagctttctgtatagtgacaacaataaaaagcctagaagataagactttgtttcaaaaaattcaagtatttagtttggacagaaaactgctgtgtgcttttgaaattttggtgagacgaagcatggtggctcacttttgtaatcagcatcttgggaggccaaggcaagaggattgcttgagcccaggagtttgagaccagccagggcatcatagtaagaacctgtctttacaaaaatgttttaagaattagctgggagacgtggcacgtgcctgtagtcccagccactctggagcctgaggcaagaggattgcttgagcccagaagttcaaggttgcagtgagctatgaacatgccactgcactccagcctgggtgacatagggagacactgtctcttaaaaaaaaaaaaaaattctgagctaggtgcggtggctcatgcctgttatcccagcactttgggaggctgaggcaggtggattgcttgagctcaggagttggagaccagcgtgggcaacatggtgaaactccgtctctacaaaaaacccacaaaaattagcagggcgtggtggtgctcacctatagtcccagttactaggatgctgaggtgggaggatcgcttgaacccagcgagcagaggttacagtgagccatgattgcaccactcactgcattccagcctgggtgacagtaagactatgtctaaaaaaaaaaaaaaaaaaaattaattctggttgaatacactgtctgctttactagttttaaatatttctctttccttatccataattttattgcctttcagattatatctgggtgttggcacccagccactattctgccaatgaagtacatcctggtcacgggtggggtcatctcaggcattggtaaagggatcattgccagcagcattggaacgattctaaaatcatgtggactccgagttactgccataaaaatcgacccctatattaacatcgatgctggcactttttcaccttatgaacacggtacgaaagtgaaccacttcccccttatagcactaggctcaactgcattctttcttccattttgggtaatttctttaggatgtagttccagatttagagtgactagatcgtatgctatgaatatgtgaattttctcatggtcattgatacattgttcatacctctgatgacattccaaattaatcatcccttttggaaacattgtatcttttgcactacagattctgttttatttttaacataaaggtagtgtgtttctcttaacatttcccactgcctggagtaactattattaatggtgacattttgatgtatgagtatatttgatttatttttaaaatggcattagcccttacatgctatttttaaaaaactttttataaggcccagtgcggtggctcatgcctgtaatcccagcactttgggaggccgaggcaggtggatcacgaggtcagaagatcgagaccatcctggctaacacagtgaaaccctgtctctactaaaaatacaaaacattagctgggcgtggtggcacgtgtctgtagtcccatctactcaggaggctgagacaggagaatcacttgaacctggcaggcggaggttgcagtgagccaagatcgagccattgcactccagcctgggcgacagagcgagactctgtctcaaaacaaacaaacaaacaaacaaacaaaaacaacaaaaaaccaacccccaaaaaaacctttttatatacaagcaaaaaagtgcataaatcataagtgtacagttggatgaattttcattaaatgaacacactgtgtaaccagcccctgatcaagaaacagaaatgttcatgtcctgccgggcgtggtggctcacgcctgtaatcctagcactttgggaggctgaggcgggcggatcacgaggtcaggagatcgagaccgtcctggctaacacggtgaaaccccgtctctactaaaaatacaaaaattagccgggcgcggtggcgagcgcctgtagtcccagctactcgggaggctaaggtgggagaatggcgtgaacccaggaggcgaacttgcagtgagccgagattgcgccactgcactccagcctgggtgacagagtgagactccatctcaaaaaaaaaaaaaatgtttgtgtcccttgttgctatcctgtcttcctgtttttgttttttgagacagggtctcactctatcgcccaggctggagtgcagtggccaagatctcggctcaatgcaacctccacctcctgtgctcaagtgatcctcctgcttcagtcccctgggtagctgggattacaggtgtgcaccaccacacctggctaatttatgtaatttttttatagagctgggatttcgccatgttacttaggctggtctcgacctcctgggctcaagcaatcctcctacctcggcctcccaaagtggtggtattacaggcatgagccactgcaacaggcatgagccactgcaccaggccttgaatatcgtgttttaaactttactaacctgagaataaaacaaacaaaaagagggtatcttattgttttaatttagagttctttgattttgattttgtttgtgaatgacttattcaagtctgtggtagattgtatttttgcttcaaaatgttacccaccatccctctgtggagtacatttccctgccctttgaccttggagtttggccacgtaggatagttaacttgtcctggtttgtttggaatgttcctgattttaaaacagaaagtcctgtgtcctgggagccctcttagtcctgggcaaaccaagcaggttggtcactctatttggccatgtgatttattttgtcctatgggatgttagggaatattaacatatgccttgttgaagcagaaaatgtcaaatgcatctgtgtggtttggctcagtctgtcttgtgcttctgccctctaccatgagaacagcctggttttcagagatttctcgttcagtctgggtcctggaatgagaagacacaaagaatagactcacaagtgactcatagcccccatgtaacatgagggagaaataaataaatgttttgtaagttgcagagattttggggttgtttgttgtgtggcaccattgactaatgccatgtgttacaccaaattttctttggatttttttttaatgattttttttttctttttttgagacagagtctcactctgtcgcccaggctggagtgcagtggtgtgacctcggctcactgcaacctccgcctcccaggttcaagcgattctcctacccagcctggcaaacatggcgaaactctgtctctatttaaaaaaataataggccgggcacggtggctcacgcctgtaatcgcagcattttgggaggctgaagcaggtggatcacgaggtcaggagatggagaccatcctggccaacatggtaaaaacctgtctgtactaaaaatacaaaaaaattagctgggtgtggtggtgcacacctgtaatcccagctactcaggaggctgaggcaggagaattgcttgaaccagggagtcagaggttgcagtgagccgagatcgcaccactgcactccagcctggcgatagagtgagaccctgtctcaaaataataataataataataatggtaatacaaagattagccaggcgtggtagtacatgtctgtaatcccagctacttgggaagctgagacatgagaattgcttggatccaggaggcggaggttgcagtgagctgagatcacgccactgcactccagcctggttgacagcgaaactctgtctcaaaaaaaaacattgaaaaaaaaaattgaaaaaaaaagtattgtgatatcaatttgcttttttccttaaaattaattttctagaccacagttatgtaccttagaatggataaataaattaggatataaaaggcttctgattaaatttgtaagttaatcaaccttttttcctgtggacatctaacagtaggaataaatgatagttcccttaataggggaaaggttcaattcttacaaggtggctttagaaacatacgactctcagtccatgccctgaagtgacaatagagatctacagacgtgtctagtagttaaagttggtgctcctcgtgtgacgaagtctgcacctgtcttttatgacagtgcattgtgcacgtagcttatggcacacacaggctttttccctcactttcaccaagttgccttatgggttagctgtggccttgctttgtcatctactgtctaattatggctttaatcaagatgagaatcaagtaaaagtttcttatcgcagttccagagtccaggatactgatgctttgaagtaaaatgctgtttgtttttaaaatttctgttttcatgtcttttttatgtggcatatgttgagtttggaaaagctaaatcttgaagacagaatttcagtagattaaaaaaaaaccacaatagaatattataaatagaattttctgatgcattttcttggatataattgaattgttaatatctccaccaaaaaggagatggtgatagaatatggcttacaaatacatcttttaccagctttttaacaaaaatatgtccatctttgaaaaatctactggaagcaaagttttgatttttccattgcctttttaatcctaggtgaagtcttcgtcttaaatgatggtggagaagttgatttagaccttggaaattatgaaagatttttggatattaatctttataaagacaacaatatcaccacggggaagatatatcagcatgtgatcaataaagagaggcgtggtgattacctggggaaaacagtgcaaggtattatattccacagacattatggagccctgtgtgctgaatatctttgtactgctcaaaagtagaactgaaggccgggcacggtggctcaggcctgtaatcccagcactttgggaggctgaggccagtggatcacctgaggtcaggagttcgagaccagcctgaccaacatggtgaaaccccatctctactaaaaatacaaaaattagccaggcatggtggcgcatgcctgtaatcccagctattcgggaggctgaggcaggagaattgctcgaacccaggaggcagagattgcagtgagccgagatcgtgccactgcactccagcctgggcgacagagtgagactccatcttaaaaaaaaaaaacaaaacaaagccaaaaaaaccaagtagaactgaaaatgtcacagtccctgcgctctacaagttctaattcttttaaaattgttgcgtttttttcttttcattttccaaaaatatgtcagggtaacttgccaggtgactttcaggtgattggggaggcctaaagcacattcttttctcatgagcatggaataaacttttgtattaatacttctttctacagttgtccctcacattactgatgctgtccaggagtgggttatgaatcaagccaaggtgccggtggatggtaataaggaagagccccaaatatgcgttattgaggcaagcatagaactttctttataaaattatatcctgctgggtctttgagcatctgatcttcatttatttgacaaatacttacacacgccctcctgagtgctggacactgggctaggaggtggggtcacagcaagaaacaacatagatggcttctgtctttgtggtcacaagtgagtgggcaagattggcattagacagacaatcacacctactcctgggtggacgtgcagtgatctgcttgtggagactgatcagctgctgataaagtcaatgtgagggcctcttctgtgccggggcctgggatgggcacagtctctgaccttggggagcttgcagacaaccctgtctacacacaacagactgcattctagtgcatactatttgaaaagtatttccgaagtgctttggaagtgtaaagagacactgggttagggaagtcagatggtagcggtgataagtgattagtatcagctgtttaaagaaagaagctagtggctgcgcgaggtggctcatgcctgcaattccggcattttcagatgccagggtgggaggattgcttgagtccatgagtttgagacagcctgggcaacatggcgaaaacccgtctctacagagactacaaagattagctaggcatgttggtacgcacctgtagtcccagctacttgagaaggtgagatgggaggatcttttgagcccgggaggttgaggctgcagagagcagtgattgcaccagcacttcagcctgggtgatggagccagaccctgtcttaatttaaaaaaaaaaaaaaaaaaaaaaaaaagtcgtatttgaacttgccacttgtttacttccttcaccttgttcccttcctctccacgtgcagaatgacaataacatccatatcctcctcctctaaatgtcagttggcttaattgccgggcgaaagagcagaataatgaccaatttggttcttagagtcaggctgcctcagtttgtatttctgcagtgacccctgagccacgtatagctcagtgattaagagtctggaggcaaactgtctgggtttgtagcctagcaaggtcacttatggggaggagggggtgaccttgggcaagtttgctcaacctctctgtgcctctttaactcatttaactcatttgtaactcattgttttgaagattaaataagtctctacacttagtgcttagaatggtgtcacagatatagtaagtgcttaaaaattattagctattattaagatgcctgtatgacttttggaaaattctcacagtttcaacgtcctcatttgtaataatgtaataatataatattataataataagataataacaggattggggattaaatgcaatgtatcagagcactttgcaatgtctggcatttaggaagtgctcagtgaacataagttagctattattattgtcatcaatgtaagtgttagcagatatcatgatatgtagaagatccattttgttaatagtagaactgataaagttactggctatttattttttatagatagggtctcgctatgttgcctcgggctggagtgcagtagctatccacaggtgcgatcaaagcccactgcagcctcaaacttctgggctcaaccaatcatcttgcctcagcctcccaagtagctgggactacagtgtaccaccactatgcctggcaaatttttaattttatttcttattctacccttgaattgacttgtcttcacaatgattaatttagcacttaatatgtactagccctgatgatagctgctaaggatgtgaggttgagtgtgatctgactcctgctctccaggagctcattggctggattttaaatttcatggaaacagggaaactgacaaacagaaccccttctccgttataaccctgatgtttatatttgcttattggatactagtggtcaaccatcctctttggttgattgtaagttgtgttcaacagttgtgtctgtgcaccatttaagcttttgaagaaggactgccaaagctgatttttagttttaatcatagaggagctgttgaaatgtcttcaaagccatttttatgagtgagacctcaacttctcataccagtggagctgacaggttttatttatattagtacgagttatcttggcatgaacctgaaataatttatgcttgtcttaaaggaataacagttttctttcttcttgtttattttccaaaaaagaagactcagccaagtgtggtggtgcaggtctgtagtcccagctacttgggaggctgaggcaggaggatcatttatacccaggagtttgaggccgcagtgagccatgatctcactactgcactccagcctgggtggcagagcgagactctgtctttaaaaaaaatttaaaaagggccgggtgtggtggctcacgcctgtaatcccagcactttgggaggctgaggcgggtggatcacgaggtcaggagatcgaggccatcctgtctaacacggtgaaaccccgtctctactaaaaatacaaaaaattagccgggcgtggtggtgggcgcctatagtcccagctactcaggaggctgaggcaggagaatggcgtgcacccaggaggcggagcttgcagtgagccgacatcgcgccattgcactccagcctgggcaacagagcgagactccatctcaaaaataaataaataaataaataaaaataaaaaaagaaaaagaaaaaagactttcattaaagacaaaggcaaaaacaactttgcacatctcataaatttgctgctgcttccatttcagcataaagtattgttataggtgatattttcccttttatctggggcaacagttaacttcaaactattccagtagtaatattgaaggtttctgaacacgataatgtgggtgacctagaggtatggtaatgggaacttctgaattagcagggagactgtagtaccgctgctgaccacgtgagggcagaagctgataatgtttgaagttggcctccttttggcattcactattattgaccccccagagaatccccatcaaaacacaagatggaagcacacggtttagtttaagtgcagacctctggttttccttagaaaaaataaatgattttcaaaaattagattttggtgccttgtatttagtgggtacttacactcacttcacccctgccaagttcctgattgcatgtgatgttttcatttcgttgagttgttgttgttgttgttgttgttttttaaagagacagtgtcttactctgttccctaggctggagtgcagtggtatgatcatgactcactgcagcctggacttctccaggctcaagcgatcctcccacctcagcctcctgagtggctgggaccataggcgccgtgccgccatgcccagctaattttttatgtttttgtggaggcaaggtctcactttgttgcccatgctggtctcaaactcctgtgctcaagtgatacacctgcctcccaaagtgttgggattacaggtgtgagccactgcacccagccctggctttggttctgctgtaattttggtaacaggtactagaacactgttccttagggcttatattgaatttcaggacctttctgtcctggcccgactactaaactaaacctccagtgctgcatgcagggtactgggctcatgccctcatggggcttacagtctagtggggtagagagccaggaaacaaagacggaaatgaaatagaggcaacttgtgctgaattcctaggatgggtacagtgctgtgacaagggctagtgggatataggctgctttaggtggggggtcagagtctgccctccaaggagggtcagagtccgccctccaaggaggatgcatctctcttggactggaggataaagaggttgctgtagatgaagaaggagggtaggagggcttaaggagcaggaaggaagagcatggagtacccaagaggccagcggggaggggaccagatggcattggagactcagtgcaagggccaggtcctgagagccttttgttggctgcattaaggagatttgatgctagttttttgtttttgtttttgttttgagatggagtctcgctctgtcgcccaggctggagtgcaacggtgtgatctcgactcactgcaacctctgcctcctgggttcaagcgattctcctgcctcagcctcccgagtagctgggactacaggtgtgccccaccacgtccagctaatttttgtatttttagtagagacagggtttcaccatgttggccaggatggtcccgatctcctgacctgtgatccgcccgcctcggcctcccaaagtgctgggattacaagcatgagccactgcgcctggccttattgttagttttaatgaagcaatgggctactgaagagtatacacgtggagaaatcttttttgaagttttattttttatttttatattttttcagagaaagggtctcgctctgtcatctaggctggaatgcagtgggatgatcatgactcactgcagccttgacctcctgggctcaagtgatcctcctgccttggcctcccaaagcgctgggatcataggtgtgagccgccatacccagccacaatttagtgattttgaacgtatttataaacctctgtgtaaccatcaaactttagttctcatgctcggtttattaagaactctttttattagcttgtgtactgtgggagatgtgtggtcatttgtgtctttttttgtttgttttccattcccagctgggaggcaccattggagacatcgaaggaatgccgtttgtggaggcgtttagacaattccagtttaaggcgaaaagagagaatttctgtaatatccacgttagccttgtcccacaggtgggctttccagataagtatgtggacagcaactttgataagttttcctatgatattctatgtgtcctgcatttgaaagtggggcaccattaatcatccataggagctagtgtccagtgtgctgacgggaccccattttttttcagctcagtgctaccggagaacaaaaaaccaaacccacccaaaacagcgtccgcgcactgaggggtttaggcctgtctccagatctggtgagttgaggacagtgggtaagtctatcctgaaggtctctgggagcaggaccttcacttcttttttttttttttttttaatttgagacggagtcttgctctgtcacccaggctggagtgcagtggtgcagtcttggctcattgcaacctccgcctcctgggttcaagcgattctcctgtctcagcctccagagtatctggactacaggcacatgccaccacacctggataattttggtatttttagtagagacagagttttgtcatgttggctaggctggtcttgaattcctgacctcaggtgatccgcccgcctcagcctcccaaagtgcttgggattacagccaagagccaccatgcctggctgcccttcacttctttatctttatcatcatctaagtcctttctcattctcaaacggctcctgtgacaatgaggtttttctatctgggagccggaaaaggcttattcccttagcctcaagtgttgcttcaatctgttcttccctaggctctcatttgatgggccacattgatagttgggcaagtgtgatgtcctgtcatttatatgattcctggattctttagaatgaaggtgaaaccttgggattttcctgtgaccctgctatcaatgataaccctgtgatgggttatcactgctctttttttctttttgagacggggtctggctctgttgcccaggctggagtacagtggtgtgatcttggctcactgcaacctctgcctcctgggctgaagtgattctcccacctcagcctcttgagtagctgatactagaggtgcacgctaccacagcgcactaatttttgtgtggtgtgtgtgtgtgtgtgtgtgtgtgtttgtagagacagggttttgctatgttactgaggctggtctcgaactcctgggttcaaccaatcctcctgccttggcctcctaaagtgctgggattgcaccacgcccagtccgctgctcttatttttagtctaaacagtgatgtgtccttatagcaggtgatccagtcatcaccagtagtctctgtcagaggttgacaaataacagcccacaacttgcttgcctgtttttgtaagtaaagttttattggcatgcagtcacacccattcatttacatattgtctgtagctgctttcacactgcacctcaattgaggatcaggacagtgactgtgtcacctgcaaacctaaaatatttcccatctggcccttttgagaaaaagtttgttaaccccgatctagctcttttcttgtagttaatgaagcaacacttgtgagcctggactctgttcaccagagacgtctcgatgtttcgagttcttactgatacacttatgctgaatttgattatacttatattagtgctcagaccaatttctaatagtccagtggaatgtccaaagtgaacaagtacatacttggccaagtttcttgtaaaaagaaatgaatgtggcatcctgctgaaagtgaatcctgtttgctgaagcataactggctttgacagattgtctgccgaagttcaacgcccattgagatggccgtgaaggagaagatttctatgttttgtcacgtgaaccctgaacaggttggtgctgctctttagattttattgtctggcaggcacttctgctgatgccagtgttttgtacctcttcaatgatcatattacttttcacggcatttatgcaagcactggggaaccctgatccaaccatgattccctagcccttaagtgagataggatgcatgtttctttgcatgatcactcaacttatgtcacaaaaccagggtgggctttcttttcttgagacagagtgtcactctgtcacccaggctggagtgcagtggcatgatctcagctcaccgcaacctctgcctcctgggttcaagcaattctcttattttagcctcctgagcagctgagattataggcatgcgccaccacgcctggctaatttttttgtatttttagtagagatggggttttgccatgttggccaggctggtctcgaactcctgacctcagatgatccgcccgcctcagcctcccatagtgctgggattacaggcgtgagccatcgtgcccagtaccagggtgggtgtttaactcacagtcaaacctctagagagagaaccacatgaagcctacttatcatctctttatcttgtgtttccttctggaacacttactgctttcactcatttctcctctctacctgtggcagcttaagtcaccccaaacacacgagcacgttgacattcgcactagctcttctgactccatcagtgggctcagttgacttcattggtacagaaactgtactgtgatttgggcttaggttctctgctctgtagggctttccaccttggtattctgataattcgcttttcttttttctttccttctctcatctctgtctcttgattccaataaggcttggttataagggattggagttacctatagtttaaagagagtgatataaatggtgctcaggaaaagggtgaggtttggcagaaatcttttcttcagattataactctgggttctctgaagtctaaaaatgatcaaattgaattttggcatcttggaaaatagtctgatggagagccccctgcctgatgcctcagagtcattgccgaagtctgaactactttgaaaaatgtgatggcagattgaagggacacttctgcatctgtatgttgatatgttgtcatgccattttgtttgcgtccaatctttttttttttttgagacagagtttcactattgtcacccaggctggaatgcagtggtgcactcttggctcagtgcaacctctgcctcctgggttcaagcgattctcctgcctcagcctcctgagtagctgggattataggtgtgtgtcaccatgcctggctaatttttgtatttttagtagagatggggtttcaccatgttggccaggctggtcttgaactcctgacctcagatgatccgcctgcctcagcctccaaaagtgctggaattacaggcgtgagccaccacacctgacctgtccaatcgttttgtgtacacttcttttttttttttgagatacagtcttgctctgtcacccaggctggtatgcaatggtgcgatctcgactcactgcaacctccgcctcctgggttccagcgattctcctgcgtcagcctcttgagttgctgggattataggcacatgtcaccatgcccagctaatttttgcatttttaatacaggtggggtttcaccatgttggtcaggctggtctcgaactcctgacatcaggtgatctgcccgcctcggcctcccatagtgctgggattagttttctaattaaatgaagctaaccttgtgcaaattctgatgctagctttggttgctgggtttttgtgtgtgcgtgtgtgtgtgttatatcagtgtaaataaactgccagtctctgctgaattttgtttcattcttgtggtggcatatttgaatagatccatctaagtatggtgatttctcatcgccacttaggtcatatgtatccatgatgtttcttccacataccgagttcctgtgcttttagaggaacaaagcattgtgaaatattttaaggagagattgcacctgcccatcggtgattctgcaagtaatttgctttttaagtggagaaatatggctgacaggtaagcgaaaggaattacttgtataatctttaataatttttgagtttgggggtagaactaagacctacttgaaagggtaagcgtgtgtatttggcattttgcgtgtgcacattttggtctggatatgtctaaagatggagcatactgttgcggtgctttgctgtattatttgaagatttctggagcctttgattttgttatacataaaccaaagtgaattaaaggaattcgaattctggaaggaatgtttttttagctctggaaggattctgatttatttgatttatttgctagttcattttttagtttctgaatatttaaaatttttttttgtttgttttcttttttcttttttgagagtcttgctctgtcacccaggcgggagtgcagtggcacgatctcggctcactgcaacctccacctcctgggctcaagtcatcctcccacttcagcctcctgagtagctgagactagaggcacacaccaccacacccggctaatatatatttttttttttttgtagagacgggatttttctatgttacccacactggtcttgaactcctgggctcaagtgatctgcccaccttggcctcccaaagtgctgggattataggcatgagccaccatgcctggccttaaacagttttaaacttcacaggttttttgttttgttttgttttgcttgtttttaagatttggctaacttttcctaaagaaaatcattttggatgggaacttttggctatgctagttttgtttcatcctgcattcattaactgttcagcataattattaaaactcctgatggattctaactttcagacaagtatattaatttaagcaaagtttctctattttgaagttatatgaaaattaagctgtgtgcagtggcacttacctgtagtctcagctacttggaaggctgaggtgagaggatcacttgagcccaggagttggaggccagcctgagcaacatagcgagaccctgtatcttaaaaaaaaaaaaaaagggaaattaagtccctgtcacttgttttctttttttttgagatggagtgtcactgtgtcgcccaggctggagtgcagtggtgcgatcttggctcactacaacctctgcctcctgggttcacgccattctcctgcctcagcctcctgagtagctgggattacaggcgcccgccaccatgcccagctaattttttgtgtttttagtagagacgggggtttcaccatgtttgccaggctggtctcgaacttctgacctcaggcgattcgcctgtctaggcctcccaaagtgctggggttacaggtgtgagccaccgcgcccggccctgttttcttttactaaatgtagttgagatgggacttcttgggcagcttaggtgagcgccagtaggtgcagctgttacgtatgtaggttctggactcaaatcctggcctcttctcttaccagctgtgtgagtttgggtgattacttaacctatctaggctttttttcccttctgtatataataaggggataccagtgcctacctagtggcaattatgagaggaaaccttaaagacttaacattgagtcacgtactataataagtatcggttgctgatgttggtaaccataattaaaatgatggtgacaaaattactgacccttggtagatgactaatcagattgaggctctcttgctctttcatttacaattttaaaaaatgctttagattttctggggcaagtggaatcaggaaggaagagcagtttctgagcttagattctctaaaacccttgctctctagagtgcttaaagtgccagtcatttcacaggaattttctaagtagcttggggctgatacactttaagcactagaagttttaatattttaactctttttattggaaatagctctaaattatactctatgcgtttatgctttttttctttttcttttctttcttttttttttttttttttttgacacagggtgttgctctgttgcccaggctggagtgcagtggtgcaatctcagctcactgcagcctcgacctcctgggctcaagcgatcctcctgcctcagcgtccccagtagctgggaccacaggtgcgctacaccacggccaactaatttttgtatttttagtagagacggggttttgccatcttgctcaagtgatcttcctgcctcggcctcccaaagtgttgggattacaggaatgagccatatgcctggcgcttctgtgctttttaaagccacatgtttggtctttgtattagcttcctgggggctgccataacaatgaccactaactgggcagcttaaaaaaacacaacaggaatttattctctcacagtcctggaggtcagaagtgcaaaatcaatgcatccacagggttggttccttctagaggctctgcaggagattctctgccacaccccttctcctggcttctggtggctgccagcaatcagtggtgttccttggcttgtggccacatcactccaatcttgtcctccatcttttatttccttatttatttttttttttttgagatggagtctcactctgtcacccaggctggagtgcagtggtgcaaccagggcttaatgcaaccttgaacttctgggctcaagtgatcctcctgcctcagcctcccaggtagctgggactacaggtgcatgccaccatgcttggctaatttttgtgttttttatagagacagggtttcaccatgttgcccagcctggtctcaaactcctgagctcaagcaatccacctggtttagcctcctaacgtgttgggattaaaggcgtgagccaccatgcccagcctttggcctccaggcctccatcttcacatcaccttctcacttgtgtcttcttcccttctcttcttttgtaaggatgcttgtcattggatgtaaggcaggccctaatccaggatgatctcagctggagagccttacttatgtctgcaaagaccctttttccaaacaaggtcacattcacaggttttggggacaaatttctttgggggggggccaccattcaactcactacagcctttttatttttaatttttatgggtacatagtaggtgtatatatttgtagggtacatgagatatttggtacaggcatataatgcattataatcacatcagggtaaatggagtatccatcacctcaagcctttatcctttctttgcaatacaaacaatccaagtatactcttttatttatttaagaatgcacaataaattgttgacaattttcaagcaaggagatattgtgcatgggtgcctctgcagcactgggcctccctctgcatcacattggtggtgacattgttaattgatgcgaagtgtccattctttagctttggtcctctcagtatagcctgtagagaggtgcaaggagccaaacggaggccaaaggaacagcctctatcatggaggcccagtgctgctcagaggccaggggtccctgattaaacagggacagcttgcctgggacccgaagtcaaggtgggcacaattctccacctcctcctattcattgtcttttttttttttttttttttttttggagacagagtctcgctgtgtcgcccaggctggagtgcagtggtgcgatctcagctcactgcaagctctgcctcctgggttcatgccattctcctgcctcagcctcccgagtagctgggactacaggcgcccaccaccacgcccggctaatttttttttttttgtatttttttagtagagatggggtttcaccatgttagccaggacgatcttgatctcctgacatcgtaatccgcccacctcggcctcccaaactgctgggattacaggcatgagccaccacacccagccctcttcatctctcttgagacccgactcttgggggtggccctgcaaagaggactcccctccccctcccacagcagcttgaagtagtatcacatgcttgcctcacattcggtgatggctgatggctgagtggggcacatgagggagaccttggttgctctcggaagtacaggtccaagggggaatgagagctccctggtaggtgtgacccagtggactcacctgtaccacctgctgcccagtgactcctcccctgggaagaccagctgtgagtgagccgtaggagtaacctgtgatactgaccccagtgctgcttccttccgggggcagagctgatgttgtctcttctgtctatggaggagggagaagggggtgaagccaaatctgctgttctcaaatgcggctctgcctgcctgcctctgacatcatctctactacttggtgtgctgtcatcctgctttctgttacccgcatcctcttttttttttggagaagaagtctggctctgtcgcccaggctggagtgcagtggcatgatctcggttcactgcaacccctgcctcctggattcaagtgattctccttcctcagtctcctgagtagctggaactacaggcgtgcaccaccatgccagcctaatttttgtatttttagtagagacagggtttcaccgtgttggccaggctggtctggaactcctgatctcaagtgatctgccggccttggcctcccaaagtgttgggattacaggcatgagtcaccacgcccggcccgttacctgcatactttatggagaggtggtgtgagatacagacagctgtgaaacctccagagcaacataaaataaagtagtgagttcaagggttagcagcttgaactattttagtcaccttttagtgaccttttatcagctattttagtcatctttctagaaagttaccttccctgtcagttttgacttcttagcttcttgtgcattattcccacacatagcctgtttgtgatctagtttctcttgtactctttacagatatgtgttctttttgtttttgtttttttttttttttttttggagacagagtctcgctctgtggcctaggctggagtgcagtggtgcgatctcggctcactgcaacctctgcctcccgggttcaagtgattctcctgcctcagcctcctgagtagctgggattacaggtgcgtaccaccacgcccagctaatttttgtatttttagtagagacgaggtttcaccatgttggccaggatggtctcgaactcctgacctcaggtgatccacctgccttggcctctcagagtgctgggattacaggtgtgggccaccgtgcccggccactctttgcagatgttgatattcaagagagatattcgtcatcatggtaacatttttctaaggtgtttggggaagggtttgcttcaaagccctaaaacaccttcagccccaagatgacatttccacgtacctaataccaaaccagatatttttcatgttctttgaacagatttcctgacaaaagcaacactaaaaattgtgtctctaatggtaaaatgtgatcgagtgtcttctgtagaatggaatttttctcataaaaatgatctaaatggctagtaatattttaaatcgttctctcagcaccattcttcaggcatgccatgaataaccagacttttgtgggtcagctgggaatgtaaccattttaaatgtagacactttgaatgcattttcttacacaatgtcaccttacaaagttaatattggaatgtttcctactgacacgcagaatgcattttttttatacaatgtcaccttattaaccaatgtaagaatagctcatgtttatgagattgggatagcttttcaatttttacttttaatgcttttaactttttctctgatatacttgaatttttatctgtatctgcttgtgtaaaacaacgttgggatttctgtttttgttttatgagacagtgtctcactgtgtcgcccaggctggagtgcagtggtgtgatcatagctcactgcagccttggtctcctgggctcaagtgatcctccaacctcagcctcctgagtagctgggattgtaggcatgccccaccacgcctggctaatttttgtatttttttgtagagacggggtctaactatgttgcccagtctggtctcaaactcctgggcttcagtgattctctcgcctcagcctcctgagtagctaggactacagctgctcccgaggatttaaaaagtgccttggagtaagagcagcagctgccattgttctgtttgtgatgttctgttatgtgcatataacctttgagtttgttttctttcccaggtatgaaaggttacagaaaatatgctccatagccctggttggcaaatacaccaagctcagagactgctacgcctctgtgttcaaagccctggaacactcagccctggccatcaaccacaagttgaatctgatggtgagtcctggcctggtcttttggctatctcagtaattcatgccaatagcacatgttccagaggggcaagttttgttaaagggtccctgagatcacctgcaggacttacgattcaccagaagaactcacaggactcatcatatagttatactcatagctaagatttattatagccagacaatgcaaagcaaaatcagccaaggaaaagtcgtgcagggtgaagtctaggagtaaccaggcgcaagcttctaagtgctctcccctggtagagtccagtgagttgtgataatacatgcaaactgccatttactaaggaagctcattgaagacttgaagcccaaggtttttactgggggctggtcacgtaggcaccctcttcttagcacttcccaaaatgccagcctcccagaaggaaagcatgcagcagaaaccatgttgtctgtacagacactttcagcacagtgagcttctcctatcagttcttggaatgatgggaaccctcccaaaatcagagtttccagaagccagtcaagtctcaatcttgtagcaggcctttccaagggcagcagccaggcttgctgtgtaaacggttttcttttttccttttttgagacacagtctccctctgccgcccaggttggtgtgcagtggcatgatctcggcccaccgcaacctctgtcttcaccgttccagcaattcttgtgcctcagcctcctgagtatctgggattacagactcccgccaccatgcccagctaatttttgtatttttaatagagacggggtttcaccacgttggccaggctggtctcgaactcctgatctcaggtgatctgcccgtcttggcctctcaaagtgctgggattactggcatgagccactgtgcctggcctgtgtaagctgttttctacatgtaggtttaaggcacatttctgaaagtaggctttgcacattcagatgaatgagcatgcttgtcatgctcgtttaagtacgtcgtaattgcctaacaggaaaataataggacattttttccctttagcattggaatggaatctagattttttaaaatactatattcccctctctaacatggaggaatgatagctagcaaacagtgattatttgttttggaaactcagtattgtggaataacagaggcgtagttatcttatatagcttgagtatattcttccatataagaacggaagtagtacatgtttagagtaaaacatttaaacaaagcataagccaggcgaagtagttcacgcctgtaatcccagccctttgggaggctgagccaggtgggttgcttgagctcaggagttgaagaccagcctgggcaacaatgggagacctcatctctataaaaaaaacttaaaaagttagccgggtgtggtggcatgcgcctgtagtctcagctaattgggaggctgaggcaggaagatcacttgagcccaggagtttgatactgcggtgagctataattgcgccactgcactccagcctgggtgacagattgagaccctgtctccaaaaaacaaaacaaaacaaaataaagcataaatctaaaatgcagaaagcagattcctcctccctgaaatcccacttgttaccagttggatacgtatatttatatatctatctcacatttatatttaatgatattcagtatgagtatatcattgtttaagcaagtcttatcatcttgacttaaatggcaaaaactttgtataatgagtaaaaagatccatttatatgttaaagaaatttaatggcttccactttgacactagcttaggagaactagctgctgtttctctctcctctttttagcctccttctttcctaatcactttttaaaaattttattttattattttttaattaattaattagttaattactttttagatggagttttgctcttgttgcccaggctggagtacagtggtgccatctcagctcactgcaacctctgccttctgggttcaagtgattctcctgccttagccacccgaatagctgggattacaggcatgtgccaccacgcccagctaatttttgtatttttagtagagatggagtttcttcatgttggccaggctggtctcgaactcctgacctcaggtgatccacctgccttggcctcccaaagtgttgggattacaagcgtgagccatcgtgcctggcctattttttaatttttatagagacggggtctcgctatgttgcccaggctggtctcgaactgctcaaacaattcctcctgccttggcctcctaaagtgctaggattacaggcgtgagccaccatgaccagcccctaatcactttttacttttggctttctaaggaatagtttacttcccattcctcccactccttcaagtcgcccgccccattatgtaaaaaaaagaaaatggcaatggaaaaattgccatgacatatacattttataaagcctttagaaatttgtatcttaaagtttatttgaatagtcttttttttttcttttcttttctttttcttttttttttttttgagacagggtctcgccctttctcctagggtggagtgcagtggtgcgatcttggctcactgcaacctccacctccggggttcaagcaattcttgtgccttagcctcctgagtagctgggattacaggtgcccgccaccacacctaattttgttatttttagtagagacagggttttgtcatgttggccaggctggtcttaaactcctggccttaagtgatccacctgcctcggcctcccaaagtgctgggattatagacgtgagccactgtgcttggccaggagagtcatttttacagaagaaatactaaactaatatagatagagagggactgttatatacataagaattggtgcacatgatgcttcatctgataggattcattgacattagcttctcctaagtactgtttgaatcctggccttgtcatcttccttctaagattgggctgcatctgtctatctctcctggtttgctgcagctgcagcggcttccgggctggtttccagctgccagtcttccctgcctttgccacactctaccagagtgatcattgtaaaatctttctcggttctctctgttcctgtcgtccctttacttaagatctttcagtggtgtctcagtctgttcaggctgctgtaacaaagtaccatagaccaggtggcttacaaacaactgccatttctctctcacagttctggaggctggaagtccaagattagggtgccagcatgtggccgggttctggtgagggccctcttttgggtgcagaggaccaacctctggttatatccccatgtgcggaaggggtgagggaggtctatggggccttttttataggggcactaatcctattcctatgtgctctgccttcttgacctaatcatccctcaaagaccccacctacctcctaataccattcctttgggagttgggatttcaacataggaattttgggggaacacagacattcaaaccattgcaattggcttcaagtgtcaagtctgtgtcatggcttctcagcctcgtcccttgccttcctccaaccaatcaggtctgtcctctcgctgggtggggccttttttgagggtcccagagtggctaccactttctctctttttcctctgaggtttcatataagtggttcctttgctggagatttcttttttttttatttatttttatttttttattttttgagacggactctcactctgttgaccagacttgagtgcagtggcacaatctaagctcactgcaacctctgcctcctgggttcatgtgattcttctgcctcagcctcccgagtagctgagattacaggcacctgccaccatgcctggctaatttttatatttttagtagagacggggttttgccacgttggccaggctggtcttgaattcctaaccttagatgatctgcccacctcggcctcccaaagtgctgggattacaggcatgagccaatgcgcccggcctgctggagatttcatacccttctcccctcctctctttgtctcctgctgcctcccatcacacacgtgcttatcttgcttctgctctcctctcggctggcttcttgaacattacctccccagagctcttccttgacgtcaatccttcctgtctttcctccagtgttcagttctagtgacgtcctagttgctttttttttaaatttttttttgagacagtgtctcactctgtcactcaggctggaatgcagtgttacaatcagggatcattgcagcccggacctcccaggctcaaaggatcctcccacctcagcttcccaagtagctggggctacaggcacgtgccaccccacgcggttgaccccaagttacttctgcatcgttctcttctttgtctgtcatagccattatcacagtatagtgtggatgcccgtttatctggttttgtaatctttctgaaagattataagagccgcaaaacagagactgtttttctatccctagtgcccagtacagtgtttgcataataagtaattattgaataatgtgtcatagtattagatggctgcagtatttttgagtgtttatttttcttaaatactccttttatctgttggatgttttttagtacatagactccattgatctggagaagatcactgaaaccgaggaccctgtgaaatttcatgaagcttggcagaagctatgcaaagctgagtgagtaccagggcccacgcacaccagttaggataggaccattgtactttttctgtaatgattcagtttaccctaattgctaattttcatgcattttgaaaggtagtttggagtacttgtggtctttgcaggtgattgttccacgatcatactgcgttgatttgaaatgtgccatgttaatgctggtggcatgtgcatagaaatggttttatttggggaggatggggatactgtgggaaagtgtgttgattctcctgaaggatgcagagggaaagtgtgttgattctcctggaagatgcagagatgaatcttacatatgcaaagttaaagtacaagaatgacagctttttttttctctctctttttacaaagtgaaagcaagtttattaggaaagtaaaggaattaaagaatggctactccacaagcagagcagccctgagggctgctggttgccccttttatggttatttcttggttacatgctaaagaagggatgaattatacgtgcctcccccttttagaccttatagggtaacttcctgatgttgccatggcatttgtaaactgtcatggcactggtgggagtgtagcagtgaggatgaccagaggtcactctcattgccatcttggttttggtggcttttagctggcttctttactgcaacctgttttatcagcaaagtctttatgacctgtatcttttgctgacctcctatctcatcctgtgacttagaatgcctaactatctgggaatgcagtccagtaggtctcagccttattctacccagcccctattcaagatggagttgctgtggttcaatatttcccctctcccttttataggagaactcttaatactaagggttgcagagggacaaagctccatcttctgtaacttcttcgtgttgaataggggcaatgacattcctccctattagagtctcttgtatttggggtagagaagaggtcagtcagaaagcgtcagatggcgagggccattcataactctgagttccaacaaaaggtgatatctggaagattaataaatgtttagtttaagaaaacattgagtaagcttattctgcattcctacacaaagagtacaatagcaatatattccacaacagtaaagcaaaaaattatcccaagtaaactaaattagaaggctttccatgaactgggcaactgttggaaccaagctgatatgcagttgctagctgatttcaatacatgcccagaattagaatactgatcccaatttttacgttacccatccctcttgttttttttttttttttttccgagacagagtcttgctctgtctcccaggctggagtgcagtggtgcgatctcggctcactgcaacctccgcctcccaggttcaagcaattcttctgcctcagcctcccaagtagctaggattacaggcacgcgctaccatgcctggctgatttttgtattcttagtaaagacgggtttcaccatgttggccaggctggtcttgaactcttgacctcgttatccacccgccttggcctcccaaagtgctgggattacaggtgtgagccaccacgcccagccctgctcttgtttttttctgagctgcagtcacagatcactgattgtttcacaggaataagcagggtcagtctaaattgcagaaaaaaacttcaaaaacaaccaataagactagaattcataataataacagttagaccatagttcttgaaacataattttttctctctccagtttcccattttcactaaagacaaatcatggtaagaacaatttgctttattatacttggcctgattatttgtataaagtgcagcaagaataattatttttcaataggcttttaaaattggctttgacagaaccttattccataaggaatctcagataagaccttttttaaagctgagcccacccatgggtttgtaccctcaaatacctatgaattgggtaaattcctctctttttgaggtcccaagataacttgaggctcctggacctgtcagaaagtgacattctttagttaccacaggtcagaaaccctgtacagggactgtgtagacaaggtatgaggctagttttcccacggggcttgtattggctttacaattcaagttcgattctttacaggaaagcacaccattccagtcaaagccttggtaatataaccagtttctccctccaattgtgtcctgttgcaaaataaaaaagattcttattgcacttatgcaaacaactatattgccataagttaagaatactcacaaattccaaatttcccaattctggacaaatcaggtagagagaaacaaatatgctccaaattttgttcacaggagtatactttactcaattgttacaagctgtatatagctcaaaagaacagttttcttgactccgaaaaataaaacaaaaaggatcagcaacattttaagcaaagtaaaaaatattaattttttattagttcattccatggagctaactcctgttctacttgatagtcatgaacatttcagctctccatgagagtcctgaaagattttcctctattctgctgtcacaatctccaaagttatcagaaacttgcatttaagaacagctgttagagttctatagttgatttttaactaccttctaaagaggaccaaaacaatacaattgtctgtgggtgacaaaatgttttagggcagccactattaaagccacaattgactaggaatttgttacatctgtggcttacaacaattttgcataacaatgataattattaataacatacacgaattcatattagaattatagaagtttcttataattttggaacacatacaataacatatttatacaaatacagcccaaagaaagccaaacaccatttcatatttgacagtgcttttcgtataatttttataccaaatataccaaacttcaccattgcattagtgcattaaattcatgtcaaacccaatttttaataaaaccttatagataaatctatccaattttagtttgaccataaggtaagatttttacaaaccttctataatcctttacaagttttttttttttttttgagacacagtctcttgctctgtcaccgaggctggagtgcagtggtgtaatcttggctcactgcaacctccgcctcatgggtccaagcaattctcctgctccatcctcccgagtagctgggattacaggcacccgccatcatgcctgactaattttttttgcatttttgtagagatggggtttcaccatgttggccaggctggtctcgaactcctgacctcaagtgattcgcccacctcagcctcccaaagtgctgggattacaggcatgagccaccatgcctggctcctttagaagtttttgttaaagagcagatcagcactctaagagaaacctgttgtgcttttatttcaatgttcaatttatggaaaacctgaatacacctttaactttagccaatgtccacacgcataatttctttttttttttttttgagacggagtctcgccttgttgcccaggctggagtgcagtggcgcaatctctgctcactgcaagctctgcctcctgggttcatgtcattctcctgcctcagcctcccgagtagctgggactacaggcgcctgccaccacgcccggctaattttttgtatttttagtagagacggggtttcaccgtgttagccaggatggtctcgatctcctgacctcgtgatctgcccaccttggcctcccaaagtgctgggattacaggtgtgagccaccatgcccggcctgcgtaatttcttttataagattaatccttcacaaaccttctacaacttgctcaaactttcagctttatcttatctaacttaaaataatccgttagctggatgcggtggcttacgcctgtaatcccagcactttgggaggctgaggtgggtggatcacctgaagtcaggagttctagaccagcctgactaacatggtgaaaccccgtctctactaaaaatacaaaattagctaggtgtggtggtgcatacctgtaatcccagctacctgggaggctgaggcaggagaatcgtttgaacccacgaggtgaaggttgcagtgagccaagattgcaccattgcactccagcctgggcaacaagagtgaaacttcgtctgaagacaaaaacaaaacagcaaaaaacaatcctttaaccttttaatctaggcaaaaaaaaaaaaaatccacattttcatgccttcttataatcttttactaaaaacacatttcactttccttatgcaacttgcatgtaaaactgtttcttcagtagtctcaattacagattacactgttaactcttaggaacttttacttttggtgaaaaacctggttagtaagcaattttaattacgtactaggtatggagcctaggacactagataaggtctgaccttttccagcatagctagggggcatggctttcaacttgtccccaagccttacctagaatctaatgctccaaagtaggtaaattgaacaattttcaagagtcaaagcagtttatgaccttaaagcattgagaaaacctaatatctgacctgcctaatttagaccaaatgtctttattttcccaataatctttaaagctgtttttattacccaaagattactaaagttatgtgaactaaaagtcattacaatttttacttttcttacacaatacttgatttaagctttactatttttaaaccaattaaagctttttttttttaacatcacacacacaacacatataaatgcacagacagaaagaagatccagtagttgtaagcacccaaatatcaatcagaaaggcttatcccctaaactaggaattgaaccctgaacccaggtcaccattgtgatgatggagaccaagagaaagtactgccacatggttgcaaggtcaagctcccaaggacatgaaacaagatgagagggaacccttatctagtttttcttcagggacctacagcaaagtttgttattgaccagtttgctggggtggcttgaacagcaggcttacaggggtcctaggcccacattctatcctaagacccctcattatgacagaacaatacagaaagacacacaaagcacaccagattcactgtagcttaagagtagcctcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcatgaacccgggaggcggagcttgcagtgagccgagatcccgccactgcactccagcctgggcgacagagcgagactccgtctcaaaaaaaaaaaaaaaaaaaaaaagagtagcctcacaaatcctttttaccattaatcaaaactttacacaggagacagtgatttttaccattcattcaaccaatttgcacagagagagagagaggccagaagtctgactggtaagaaattcttacccttttgtcggtatgctaggcttctgggttccctttccttgagcagccctagtgacccggctggctgcaccacagccctgggggccaagctgtaacacaaaggaaaattatcttttcctgttctggccagagcaaaatatgtgtgacaaaacatagacattagccactctgcctagcacccaatatcttactggcaaggctcaaacttgcccctggttgggccccatcatcattaatccaacctctgaccaggagtttcaacttgtctctgggcaagatggtcgccttgagtaacagaaaagatacgaaaaggaaaggagataaagggagaaaagcattgcccgcagcattttggggaaggcaaagagctcagggaggccagagaaagacgcacccattgcagtgacactgaaaagttcaggtggccgcttgtcggtcgtgaagggatcttttccaggagtctcatcaactctcaagtttccccttttgaggaggaaaaagctccccatgtcccatggtcctgtgcatgcctagttctgtcacccatagctatcagcaaagagtgcaaggcagaataatccaaagagaatagcaattaacatcccatagtgccaaacctattcttagcagagagggactttactgagagaggcctctaaccccctaaaccttaggaaggactctaaccttcctaagttgtgcctccaacccaaggtcattcaagcatccttgccttttattgagaggagcctttaactctctctgttttaggagagactctaagttgggcctctaacccaatcccatcctttacctgggtatatgcaccccatttacccaaagtcagccaattggtgcacacagacgattttcctttgggtctggggtctcttcagtattgttctttccgtgtttcactagaaagatgttactggaggctgggcatggtggctcacgcctgtaatcccagcactttgggaggctgaggcggtcttattgcctgagctcaggagttcgaggccagcctgggtaacatggtgaaaccccatctctactaaaatacaaaacattagctgggcgtggtggcgtgtgcttgtaatcccagctactcgggaggctgaggcaggagaattgctggaacccgggaggtggaggttggagagggccgagatcgcgccactgcactccaggcagggtgacaagagcaagactctgtctcaaaaaaaaaaaaaaaaaaaaaaaaaagaaaaatgttactggaccccaccacgtactcagtattgtcccttctgtggtcgctagaaagatgttaccagaaacgggtcccaatccagaccccaagagagggttcttggatcttgctcaagaaagaattcagggtgagtccatagagtaaagtgaaagcaagtttattaggaaagtaaggacataaagaatagctgctccattgacagagcagccctttctctcttgatgatattttccacatgtcttagattttaggttttattttgtaagtaattgacagaactcttgggggcagcattgcatcatgaggttagcatgatcctcctgggttttctgttgaactgtgttgctgttgtgtttgcctaggtctgtgaagtcttctagccaagaaattttcatttgccactacttaattagcatttgaaatcttaggctgatttttccaatttaactctttctgatgatgtcagagatcttaacatttttataatagtgttttgaaagaaccttaacctattttcattcagtttcttttcccagtggcattcttaattgaattgggtttctcagttagtatgctctgatgccacaaagacttatcgtaaaatatatattgaggtcagttgtgagaaattgtcacaatttcttcataacattgggaagatttcagaaaaaaagttcagggtgtgaagtcatataattggttctgaaaatagagcttgagcatagtcactagtgattggaccaagcattgcacgaatggctgaatacactagtttaaaaaaaaaatggatagtcaagtttaccctcattttgtattgatttcagtggtattcttgtgcctggaggctttggaatcagaggaacattgggaaaactccaggcgatttcttgggcaaggacaaagaagattccttttctgggtaaaactcatgtttattgaccctaactatgagtttattagatttttgacacctaggaggggtaacactaaaggtttgttatcgtaaaggtgtgaactcggatttgaaagttcaggtgccaaatagtctgctatagggtcaacaaactatattctaaatttggcccacagcctgtttttatgaataaagctttattggaacacagccacaccaatttgtttacatattgtctatggctgcttttgtggtccaacgtcagagtttcagaccctacggcctagaagctttactatctgaaagaggctagaatctttactatgtgaccctttacagaaaacgtttctcatcctaggagaacttgctgctattccagctgggtagcagaggctgggagaaggctccatctgcaactgtgcttaccttctccaattcccacctcagtctccagagtagctgggactacaggtacacaccactgtgcctggctaatttttgtgtgtgtgtgtgtttttttttttttaagagatggagtcttgctatgttgcccagcctggcctcaaactcctgggctcaagcaatctgcccacttcagactcccaaagtgtggggattacaggcttgagcccccgtgcccggccgagttgagcctttttaatgcttttttttcaaattgcgaagtacggcttctgtaccagggaaaccagaggaaatgggaccttgatgcgggagaggcagccctgtagctggggactcaggcaggagggggagtgcagagaggctgtgtttcccactgtgcagtggatggctgggtgggtttatgagcccattggacaggcttttagtgccagcagaccatttatttccccccattacctgctctttgattagcttcttagactctctcctcttaggatccattttcaaaatagaagactggagtagttacctggataccttgttttcttttactggtctaagctcgttgggggccattgtttttttttttgaagtttctgtctaaatgtgggtaatgttcctcagattattttaatagtatggaatggtttgcaggtctttagctttccctctagcatagcatctctttatgtcccagccatatggaactttctgaaatccccctcaccgccacccccaccccccagcactcagctgtttcctgcttattgacttctgttctggcatccctgatatattgattgctcccttctttgtttcccctgtgtacatcttaagtatctatcggaggagcatctgggatgctctttggcatttgtttagtggagagaattggtgaactgcagtgaaggcggagctgggtctgggagcatccctgtggcaacaggcttgggcgacacaggtctgccttccttcatcaccgagcactctgttcaggcccatcgtgtctccttccctgctgcccaccatgctcaagcccactgtggagtctccaacccccaccccccactgctgcttttccttacagtgaaggctatggggctgcctgtgggttagcagcctgacgtcctgtaggcactcaacctctggccaagcctgtgtttatggctgtgaagtcaccatgagaaggagtgggaaatcttagcccaggaaactccctctgagttggggtgttagatgttctctgaaggaatcaggcactgcagcccactaagatgcctcaactcagggacaaatctagaaggtggcagatttgtctcatggactctgcctctttctttccttctttccttccttccttccttccttccttccttccttccttccttcctttccttccttccttccttctttctttctttctctctttctcccttccctcccttccctccccttccttttccttctccttccttccttctttcttccttcttccttccttccttccttccatccttccttcttcccttcttccttccttccctccttcctctctctctttttattttctttttttttgagacagagtctcgctctgtcgcccaggctggagtgcagtggcgcgatctctgctcactgtaagctctgcctcccaggttcacgccactcccctgcctcagcctcccgagtagctgggactacaggcacccaccaccatgcctggctaatttttttttgtatttttttttttttagtagagatggggtttcaccatgttagccaggatggtctcgatctcctgacctcgtgatccgcccaactcagcctcccaaagcgctgggattacaagtgtgagccaccgcacccagctcctccttcctctctttctctctttcttctctttctttccttccttctttctcacccagcctggagcacagtggtgtgatctcagctcactgcaacctctgcctcccgggctcaagtaattctcctgcctcagcctcccaagtagctgggactataggtgcatgccaccacacctggctaatttttgtatttttagtagaggctggtttcaccatgttggccaggctggtctcgaactcctgacctcaagtaatctgctcactttggctttccaaagtgctgagattgcaggcttgagccattgcgcccagttgaccctgcacttttctgacctcatgttccttctttgtcaactttgggacttaggcggcttcatgatagtctaagcccctgccctgctctctgtcagggattcttctgagaggacagcagggagcaaaacaggcagagtcttgctctctgggagtctgcattctagataggggagacaggcagccaacaaatgaacagaaaatgtgaacaaatacaaagtgagttcatttgctttgcatatgtgctttttaaaataggagtttgtcttgggatgcaactagcagtgatagagtttgcaagaaactgccttaacttgaaaggtaagttcgaggtttgctaatgaccatttatttaaaaaattttctctcttcaaatatttttcagcactattggtgaattactgaactcttttcttaatcttcagatgctgattccacagagtttaggccaaatgccccagttcctctggtaagtggcttgtttatctttctgggtccagtcattgtcacttgggtcctggctcttgcctaaattcataaggggctattggctgggcgccatggctcacccctgtaatcccagcactttgggaggtcaaggcgggcggatcacttgaggttaggagttcaagagtagcctggtcaacatggtgaaacccctgtctctactaaaaatacaaaaattagctggctgtggtggcagatgcgtgtaatatcagctactcgggaggctgaggcaggagaattgctggaacccgggaggtggaggttgcagtgagccaagatcatgccaccgcactccagcctcagtgacagagtgagactccttctcaaaaaaaaaaaaaggcgggggggggtctattattattttttctttacagcaccagaacattttaaattacattattcttatattaaattcctttgttcttgatagtccatcttctcagctatgccttaaagacagtcacaatcctggactgatttctctttgtcgcagctttcaagcttaatgtttaggaaaggattaaatcggctgtgacaacaatttataacatctactataaataaatgagctgtcctgtctccagactcatcaccagtctgcctattttccacactggtggtcatctgtctttctaaaacaaaagcgacagtgattctgctgccagtcctcatcttccatcagtttcttttcccttaaaatattcagtccaggattctgggctgggtcccaaagccactgtgctctgtcacctgctgctttgctgattcatcccatggcatcctgattcctcccaggctttgagtttttttcttttttgtgtttttttgaggcaagttctcactctgtcacacaggctggaatgcagtggcatgatcacggctcacggaagcctagacctcccggggtcaaacaatcttcccacctcattttttgattttttttgtagagacaaggtctcactatgttgcccaggctacatgctttgagttttacgtttggacaatctaaactagtttttcagatacagcctgaggttccctatacctgagatgtccacctgcctaaaatccctctccccctggaatctcaataaaagcattgaaaaatttaattaacaacaactcagttaccaacaacttcctattcatctgaggaaacctttcctgacctcttttctttacctgcctctgccttctgcctcatgctactgtgctcaccactaacagagcgagttctgcaagatgatggttggccttcagtcagcctgtttgccagccacccatgcacacccagtcgtgtccctgctgctgggcacctacttctaatggagctcgcgcctcacaatcgcgattggttttttaaacagctttattgagatacaattcatataccacaaaatttagccatttaaactgtataatccggccagatgcggtggctcacgcctgtaatcccaacactttgggaggcctaggcaggtcaatcacttgaggtcaggagttcgagactagactggccaacaagttgaaaccccatctctactaaaaatacaaaaaattagctgggcgtgctggtgcatgcttgtaatcccagctgctagggaggctgacacaggaaaattgcttgaacccaggaggcgttggttgcagtgagctgagatcgtgccattgcactccagcctgggcaacagagtgagactttgtctcaaaaaacaaacaaacaaaaaactgtataatccaatggtttttagcatattcacggatctgtgccactctcattacaagcaattttgggccattttcattactccaaaaagaaaccccacacgccttagctgacacccccaagcctcctatctccaccagccccaggcaaccattagtctaccttctgtcttcatagatttgcctgtttgaatcatttaatataaatggaatcatccaatatgtagccttttgtgactggttgcttttacttaggataatgttttcaaagtctgtctatgttgtaacacgtatcagtactttgtttctttttattgctgattaatatttcattatatggacatgaaacattttatttatccattgatgaacatctgcattgtttctactttttggcattgtgactaacgctgctgtgaacattcatgtgcaagtttttgtgtggacatatgttttcatttcaccaggagtggaatttctgagtcatatggtaattctgtgtttaaccctttgaggagctgtaggactgttttccaaagtggctgcaacattttaatttcctgccagcaatgtatgagggtcctaatttgtccatatccttgtgaacatttgttatttctgtctttttgatgatagccatcctagtggatgtgaagtggtgtctcatcgtggctttgatttgcagttgcctgatggctaaggatgttgagcatcttttcatgtgtttattggccacttgtatgtcttctctggagaaaggtccattcacatcctttgtctattttaaaattagggtatttgtatttttattattgagttgtaacagttctttatatattctagatataagttccttatatataatctgtgctatcggcatttgggaacacatcattctttgttgtatgtgggagctcctgcccactaggtgccagtatcactccctaacccctgcccaactgtgacactaaaagtacctccagatattgtcaaatatctcttgggggcaggggcagaatcgccctggttgagaaccactgatttagagaaatctagttctatttctgtcccctgtagcctgtttaatcccttcccttatggcaagcattcattcttttttttcttggttcatcttcccattttttacatataagtaaagctgtatgtctttgtcatccacttcccttcttagggaaatggtagcatactctacacagttttttcctgccttgcatttttcgcttaacactgtatgctggagatcaccccacggaagcacatagaagcattcttcactctttttttttatagcttgtaactcaaaccataatgaaccataacttaccagccagatggtacttttaagtcttatgctcagaaggcctaataccaatgaagggttccttatgagcctttaatataaacatatttcctgactaatagctgaaatggctgtgccaggaaaactatgggttttcttttctaagatatactttgggataggaagtgattttaccagtaggtgccactgttagatagtgttggcaaggttaattctttgatgattattctttactgggggtgtgtgtacgtgcgttaaaaaatttttacacatggccgggcgcagtggctcatgcctataatcccagcactttgggaggccaaggcgggcagatcacaaggtcaggagatcaagaccatcctggctaacatggtgaaactttgtctctactaaaaacataaagaaattagctgggcgtggtggcacgcgcctgtagtcccagctactcgggaggctgaggcaggagaatggcgtgaacccaggaggcagagcttccagtgagccgagattgcaccactgtactccagcctgggtgacaaagcaagactctgcctcaaaaaaaatgaaaaaaaatttttttttacacagagtaaaaaagttaagccctgcagaaaaaggtacagaactgtctctcctttgcccccacctcacttcggttcccttccccagtggcaactactttgatccatttctttctttctttttttcctttttaaagagatgggctgtctcactatgttgcccaggctggatattcacaggtgtgatcatagcgcactacagcctcgaactcctgagctcaagtgattttcccacctcaacttcccaagtagctgaaactacaggagctcagctgatgcatttctttagttatttcagagatttgtgtgtgtgtttttgtgtgtgtatacccacttagccacacacatatgaatatgtattgcgtttaaaaaaaagatcttggctaggtgcagtgtctcatgcctgtaatccctgcacttttggaggctgaggcgggaggactgcttgagtcttggagtttgagagcagcctgggcaacatagttacaccttgcctctacaataaataaataaaattacctgggcatggtggcatgcacctatagtcctagctactcgggaggctgagggggaggatcacttgagccccaggggttgagctgcagtgagctgtgatcacgccgctgcattccagcctgggtgacagagcgagaccctgtctcaaaacaaaaccaaacaaaacaactttgtagcatgctccagacactgttcccaccttgctttatatactgatcattccacatcaatgtgcagggatgtcttcggtgtgcttgctctgctgtatgctatatggctgcatccttatttatttaaccagtctcatatttagtttgtgtccattattttgctgctttaatttatgctgcaaattagtatccatgtacatatatccttgcacccacgcgcgaacacatctgcagggatagattcctagaaggggagttgctaagtcagaggatgtgtgcattttacattttgatggctcctatacacataagtgagatgagaacaataaaagctaattgctattgaacgtctttatggcctgcaatgtttgttggagaaaaatagccttaagagctagcacttgtatcgatgtgagaagtcttattaaaaaaaaaaaaaaaaagactaaggagatagaatcataaggcagcaagcaccatgaagcctgcagagttacttaagcttgagcaaataacagttactttgtggggactggtcattctggctgttctagctaggaaagtaaacagtttggaaaccaggagccttctatagggaatatttactcctaagatctcttcataggtcatcatgaccctcctttggcatgcatgattagtgctatggctgttgatgaaatcaatagagacactggcatccagaacagttccaagagaaagtgtctgttatacacataaaaagagaaacagatttttccctaagggttaaggtagactctttctgcgtctcagagtgcccaggagagaatgagtaaaatttattttattgtgtcatttctctgcttaatccacaaggtgaaattgaaggctctgggactttgcagaatacttagggttctatagcaactctggttttttgccctgcttcaaagtagtctcagctgccttctagatggtacataaccaagagcgtagctgttgctgacttacattctaaccctatatcaatcacatggctgctgctgacatccttgaccttgaatttggcttcagatctctccagtacatctgtagtgtagttcacagcactttggactttatattttgaatattttcagcttttgaggcatatatatatatatatatatgaatgaacaatctcaatctaatgtgtaggcatgtgaatgtgcttaactctaagcatttcttttctgtttgttgaaaaaggtaactaaaaattctaaatttacataagatattacaccctgaagacagaattcatgttccaccttcaaaagacatcagcacacacatgcacacttggatggtggtatgggaaaggaacagggagaaattcaaagcattttaacgagatgcaaatggatatttgagattttggtatttgatattatttcagttttcattatttatcataggtatgacgtcatttatccctttttgatccaggaattttcagggttaagtgaattttacatctaccatagtagatttgtgaaacagtcacataattaaaagctgatttgggtgaaagttgatttttgttatacatgaagtataattgattaatgcataacattttcctgcctttagttgaagccctgtttaaaatattttcctcatctgtattatttttcaacaacttcatatggagtgcaaattaagaggtgttgaaaacaaaccagatggcccacttagaattatcttttaggcaattttgattactttgaggattttcttgcatttagagtgttgaagtaagcatctcctgactattacaaagatcatatagaaatcacttggaggttagttagggctaaaaatcctttttcccataaaagtagtcattaggaatacagctataggccgggtgtggtggctcacacctgtaatcccagcactttgggaggctgaggccggtggatcgcctgaggtcaggagtttgagaccagcctggccaacgtagtgaaaccccgtctctactaaaaatacaaaaaattagctgagcgtggtagtgggtgcctgtaatcccagctactgggaggctgaggcaggagaatcacttgaacctgggaggtggaggttgcagtgagccaagatcgcgccattgcactccagcctgggcaacaagagcgaaactctgtctcaaaaaaaaaaaaaaatgcagctataatatgggttaaatagctttttacagaccactctgggagcctaatactcctttgatactgtctctgtggggatagtaggtttagagttgacatcagactgttggctgaggtaacttttttctactcagagaaagaaaagttcttgcctgggcacggtggctcacacctgtaatctaagcactttgggcagccaaggtgagaggattgcttaagcccaggagttcaagaccagcctagtcaacatggtgatacctcgtgtctacaaaaaaataaaaaagtaatcctggcactttgggaggctgaggcaggtggatcacgaggtcaggagattgagaccatcctggccaacttggtgaaatcctgtctctactaaaaacaaaaaaattagctgcgcatggtggcacgtgcctgtagtcccagctactcaggaggctgaggcaggggaatcgcttgaacctgggaggtggaggttgcagtgagctgagattgcgtcactgcactccagcctggtgacagagcaagactgtctcaaaaaataataaataaataataaaaaataaattaaaaagttagctgggtgtggtggtgtgtacctgtagtcccagctcctcaggatgctgagatgggaggatcacctgagcctgaggaggtcgaggctacagtgagccatgatcatgccactccactccagcctgggtgacagagtgagaccctgtctaaaaaaagaaagaaagaaagaaagaaaaattctcctgaaagggaacccttgcacactcttggtgggaatctaaattggcattactattacggaaaatagtgtggaggtgcctcaaaaaattaaaaatagaactaccatatgatccacttatcccactactgggtatatatccaaaagatatgaaattattgtgttcaagaggtatctgcactcatgtttgttgcagcattattcatagtagccaagatacagaatcaacctaagtgttcactgatagatgaatagataaagaaaatggaaaatgtggggtgtgtgggagaaatggggagatgttggtcaaagggcacaaacttgcagttataagatgagtaagttctggagatctaatgtacagcatggggaccatagttaataatactgtaatcccagcacttcgggaggctgaaatttgcttagagagtggatcttcattgctctcatcacacacacacaacagtaactacgtgaagtgatgaatatgttagcttgctcgtggtaatcattccacagtgtatacagagatgaaaacatcttgttgtacaccttgaatatatacaattttttttttttgtcattctgtgactcctacaccttcttactccctttgtgaccttgggtggactcagcatggtgaccaaagactttcatgatctgaagtgggtgtgccctcttcattcctcatacttgacattccaccccaaacatggtgtacacattctttaaacagccttgcatttgggcatgatgtgtttgcttgggctgttttctctctttctgaatgcccactgctgcccctttcctgcatgctcccctcaaggttctttctacagagcccagttgaaatgctacttttttgatgaatccttcccctgacctggtcccaaacttactgacttagaatctcagaggtctggaaatttgtgtctctcatggcatcttgtatagtgccttgcccataataagtactttatatatgttggagttgaaatagataatgtatattaactctgcgaggggctaattgatacctagaatgaacataggctaaaatgagaagctagcatgagctagatatcagaactgaacaaaacacacaccacaaataataaaaactcaaaccatagactaacgttggttgggaatgaagatatgaaaaatctcaaataaaatattcgaacatccaatttaacagcattaaagaatgatcatgactgagtagtgtgtttatcctgggaattaaattaacacattatattgattgaacaaaagagagagactgtgtagcgccatacatgctcaacatcgaaacctggtgctcacagtctcataatgaactaggaagacaccagtacttcttaaacaagaagaatatcttccacaaagcagtagccaacagtaaagttcatggtgaaatagtaagggattcttattacaactagcaacaaataaaaaatgtgcaccatcgtgaacaaaacagttgttaaaatgagaccagcaaatgctctctgggaagtgaagctggcgttctccttcctgcctgtagagttatgaatccatacaaccttttgggaaatcagttaggtggtctgtttgacaaaccatacaaatatccataccctctgactcagacatttacttctcagaaattctcctaaggaaatcagaaatgttgacagaaatatgaataggtactcattacatttagaagaattagaaatgacaacaatctactcatcataacatttggaagaatcggaaatgacagcaatctaaatgccccacaatggggaaatagttaagattattatggggtatctgtacagtggaatgtaatgagtcatgagaaatgtttaagagttttaataccatgagaatgctcttgtgttgaattagaatgatacaaattgtatttaaacagtccctcaactgtttataaaaatctcctctgtttcttggtgggttagaaatcacctttttttttttttgagatagagtcttgctctgtcacctaggttggactggagtgcaatagcacaatcttggctcactgcaacctccgcctcccgggctcagataatcctcctgcctcagcctcccgagtaactgggattgtaggtgtgcgccactatgcctggctaatttttgtattttttgtagagacagggtttcaccatgctgcccaggctagtcttgaactattagactcaagcgatccacctgcctcagcctcccaaagtggtgggattacaggcgtgagccactgcgcccggccacctttctatttttctggttaactttctaaatgtttgaaatggcttccaatgaatttcattttattattgggggaaacttccacacttattttctttcttcccaaatctccacaagtatactctcctcccaaaatttagatagttgtatttttctgattattccaaataagagtgctgagaggctaatcacaaagagcagcagccagagatttacaaagtgttctcttactattgaacattttcacttattctttttgataggacacacatccatatggctcagaaatcaaaatgtccaagaatttgtcaagtgaatagtggctctcttattcctgcccccccatctgcccagtcctcttgaagcacgtaaccaatgataatagtttctactgtgcacttgcagagattttccaggaaatttcaagcaccttgccttccaagtcactatataccagctactcatctcgtgcccagttcactttggtcaccctgtccccaccatccctgtgcttacatcaaccggtacttctctctctctgagctcaaacaccccagagagaagcctggccctgcccagccttttatgggtagatgaggtgggagcatgggtacgtgttcctttgcccacctcggagagtcatccagcttctggaaaaatgatagcagccaacttgacagaagaacccagcatacacattcaagttcattagattaaaaaaaaaaaaaaaaaaaaggccgggcatggtggctcatgcctgtaatcccagcactttgggagacgaaggtgggtggattgcttgagcccacgagtttgagaccagcctgggcaacacaggaagacccctgtttctacaaaaagtaaagaaaaaaaattagccagtcatggtggcacatgcctgtagtcccagcttcttgggagactgaggtgggaggatcacttgagcccaggaggtcaagactgcagtgagccctgaaagtgccaatgcactccagcctgggctaccgagcaataccctatctcaaaaacaaaacaacaacaaacaaaaaaacacaaaaaaaccctgaaactaaaaataagtcaaaggcagtactttgcaggcagttattttcagcttgaaggtagagccgtatagcagaatcttggagagggcttatgttgtttgaaacgccttcagtatcatcattttctacactttgaaagtggaaatgggccgggcatggtggctcacgcctgtaatcccagcactttgggaggccgagacgagcggatcacaaggtcaggagatcgagaccatcctggctaacacggtgaaaccctgtctctactaaaaacacaaaaagaaaaattagccgggcgtggtggcgggcacctgtagtcccagctactcgggaggctgaggcaggagaatgccgtgaacccggaaggcagagcttgcagtgagccgagatggcgccactgcactccagcctgggcgacagagcgagacttcgtctcaaaaaaaaaaaaaaaggaaagtggaaatgatcccatatctttctgatgttaactacagaaagtatagtgtggcagtctgggctctagagcgcgaggtaaaaataataaatggcttgaagaacattgttcaaaggcatatcatgtacaattgggtttttgatggggagggcagcagtggggttaaaaaaaatctcatgtctaaagcacagatatgtgcacagcacataaacagatgcacaagacatctctggagttaaaatttcctggggggtggcgattagaaacaagtgtttaacaaagctccttaggaggttgataatggcttaggaaaggttgagagaggccgggtgcgacctgtaatcctagcactttgggaagctgaggcgggtggatcacctgagattgggagtttaagaccagcctggccaacatggtgaaaccccgtctctactaaaaatacaaaaattagctggatgtgggggtgcacacctgtaatcccagctacttaggaggctgaggcaggagagttgcttgagcccgggaagcggaggttgcagtgagccaagatcgtgccactgcactccagcctgggcgacagagcaagactctgtctcaaagaaaaaaaagaaaaaaaaagaaaaagaaaaaaagaaaggttgagagagactgttcaaaggcaatgggacccaatactgatactttgatacttcatgggtgttttgcggaggagagttgcgaggataaagaagaaataaaaatctagcttccggggcactgctgtgaccaggctattagggtcagcttgagccattggtaacttggacaaacttgaacgttaacatttgaactcttatctggtaaggggtagcagaaagttcccttccctccttgaacgttaacatttgaactcttatctggtaaggggtagcagaaagttcccttccctcctctgcacttcttgcctccatattccacactgttgtcacttcaccccctgcatcccctagctggacgcaaaaagtggaacttgaacttgagggctggctgttttctcagaatacaggatgccaagagttgagagggcccaaggtcttcctgtgatcttttatattacacgtcacatgccagtaccatggcgttaggctggtagacccgaggccacccggtcagtgatgagtggggccgcctctaggtcctgtgttccttctgttccccgtcgagggtcattcattaagaaagcacagcgagtgctgggagatagcatgacgtcaactgtctgtttgtgaagtgtttttcttgctcgctagtggatagtgtgagatcagagtggaaattggagatgacctgagcactgaggagttaaggaaggagagcaagcaacagggtgattctggtggaaaagtggagcaagggagttggtttggcatttctggattcttttcaggtctcccacaccatctttgtagttttcggcaggatcacagagctatcttggccctcacattttatttttttatttttatttttattttgttttatttttagacagggtctccctctgtggtccaggctggagtgcagtggcgtgatcatgtctcactgcaaccttgacctcgggggctcaagtgttcttcctgcctcagcctccctctctctctctctctctctctcttttttaaatctatagaattagttgaatcagactaaggttactttcaagtctattatgttatgaggtcagtacttaacaaagtaaggtatgtctaataatttctttattaataataactgaacctcacagccaggttattataattgcaaagaattaaaccagagactttgggggattccacataggataagaccacagcacaggcgctcttcctccagtgctcagggttctattttgttttctccttcactgggatatcttttttactaatacttggaattcttcaaaactaacttctccatctccattcttgtccagttcttgaaagagatcatctagggtgtttggaccctgttttacataaaaaaggatgggagaagggaggggagaaaaaatgaatcagttactgctacacattctcagaaattagaggccttggggtctgtgtgccaagaaggcagctcaggtttccagtgacatgcatctaatagctaacagagagaaaccagctttagctgttgtattgctccgtgtcatagaactggctacctttttgtcctccatatcacacatctgttattttaatacaatgcgtattttaatacagttgttttcttatgcgatcttgggtctttttctttatgcctctaaaaacattcttctgagaagggatctgtgggcttcactggattgcccacggcacacaaacagttgaggacccctgccccaaggttttcctggaagctgggtttgtctcctgctccagggctagggctgacatattacatgaggcagcaggcagggagggctccttctgtaatccttccgaccaccctatgagggagatctactttacaggtggggaaacaggctcagagacaggcagtcacttacttgagtgtccacagctggttaacagaggggttggggtccacacgttgactccagagctcaaccccttaactaaccaccgcccagtttttcccaaacgttgagctatgcaaaatgactttggctcaatggttcccatgctttagcatgcatcagaatcacacgataggcttgctgaccttagtaaatacagactgccagccccacctccagagtttctgattcactaggcctggggtggggcccgagaatctgtacacaaggtcttgctctgtcacccaggctggagtgcagtggcatgatcacagcccactgcagcttccacctcctgggctcaaatgatcctcctgcctcagcctcccgagtagctgggactaaaggcgtgtgccaccacacctggctaattttttaaaagttttaatagagacaaggtcttgctgtgttgttcaagctggagaatctatattttcaacagcttcccaggtggtgccaatgctgctgctctgggaccacacttggagaaccactgcttgagatgtcgtgtgagatcgtgtgcaggctttttgactactggacttcctgcagtgtcttaagtggagttaatttttgtctctaccataaaactctaatcttaaagccattactacttggactttcaggtaggagtctatctgtgcaaaatactacttagaaaaccgattgaaataacagttcagtttgtcagtttcaaattagactatattatatatatatatgtatatataaattgtggtaaaaaacacataacattgaatttacgctcttaatcatttttaagcatacagttcagtagtgctaagtagattcacaattttgtgcagcacatctctatggaagatatattttaacccctaagattcctacaaaaacacttagcactttgctttaattacaagaccaaactgtaagttacttattcagcctttgatttatgaatatgaaacactgttttcctgaagcctttactagattctaaaccatgcatggtgatgatatatgtaaacagagtatggtggaaaaccttagtaatggaaaccttatgggaatataatcaggtacatgttaagtagactttcagaacttaccattagtcttcctacctcgttccagattatgtcttacgtactttttgtaggaaagacataaaatatagaaaaagttacccgtgttaccttttgaaacaacttgtttgagtacatggcctaggctttcctgttagatgattatttttcttccttttagaaaaaataaagggtcttttaaaattttaaattttttcactaacttgttttgctgtttaattaaaaagtccctttttctgctagtgactttaagtgtttttacaagttcttctatatttcaactatgagaaaatgagaaaatatcagattctggggtcattgaattcagcttttttcttttttagtattaaaaacagaagtctttccaattgtcatattggcagaagggacatttctggttaaaatctggagagctggttaaaatatttgaagaaatgttctttcctgaagttagagctaaatagtgactgagtcatacaaaacaattccatagtcacttctgttgtgaagatggtttttaattgcaaaatgacaatgactctctcctttgagtcctctgctcgactaggcctgaccttgggcttccctctctgtccttgtatctgactacccttaatatttgatcacctggcctgccttcagctagaatcctatcaaggcaatttagccagaagctccttatcctggatatttccttggtaattttccatccactggccccccccatcctgctctatggtcataaacccccacttatcctttctggagttgagcccaatctctctccccatggcaagaacacgtttcagtggtccctgtatgggtcgccatggccctcctggagtaagttgccttaccatccttggcaagtgtcctgactcagctttttctttagcaaaaggaaagacagtactgtatattggagtgaggacgatcagctcttctctgtactctgttgccttgaatgcattttgattttgacaactctggggtgattttgatgtgaaactttatggcccaggaaatttagtcctttcttgaaagttgtttagaaatgcacggttgcctcattaacacaaatttaagtgatgaacacaaatgtaaatgcttttgaaatataaatgagtgctgacaaggcaatttgtcagtgggttttcctaacagactgctaagtaagtgttggtcttgttgagggattttacatacacaaatgaagcctgtccaaggccagctaacactattttgcagtcctctttgttttcctaaagcctggcacagaagtactgaatccatgctgaaggccttattgggtttgcttggtgacttgtgggtcttccaggcataacttggcattgcttccatttattatggctagtcctgcagagtcctgtgctgaggctgcaggagggatagaaggcttggcccttgttttctgagagcttgccttctgaaatgtggcctgacttaaggggaagaaaccccacctgcatgtgtcctccctcaagcgacggtccctataaggctctaccggagtcctctcccctccctccctcccctcccaccatcagtcccattaagtgggctctgcggatggccacttactttgagtaaactggggaattcagcctgaatcaatagcttcagttcatcctttgacaactggtctggatcaccttctttggctgcatatttttcaaaaatcctcttcagttcctcaggagactttttagtactcattctggtgtcttataaattgggaagaaaataaacttaccaaaaagctgaagtacagttttgtgctgagggttgtctgcaggattttagtgccattgggccatttccttggcataaatggggaagaataaggaaaagagaatgtcggggtcggaatggcaccagtaactactaacatgtttaaaaaataagcatcttaggccaggcacggtagctcatgcctgtaatcccagcactttgggaggccaaggagggtggatcacttgaagtcaggagttcgagaccatggaagcctggccaacatggtgagaccctgtctctatacaaaaattagccaggcgtggtggtgcgtgcctatagtcccatctacttggaagaccgaggcaggagaatcgcttgaacccgggaggcggaggttgcagtgagtgcgatgccactgcactccagcctgggtgacagagcgagcctccgctgcaaaaaaaaaaaaaaaaaaaaaaagacatcttagatagtatgttaaatgtctgttcttagagtacatctgttaggagatggtccctggagccaaacatttttattagtaattaatgacattctacactttttatgtacctgatctgcactctgcaggctgtggtcttgaagaatacttgaccacagcttctagcttctaagttacagggaatatctccagatggcataaactcaccttctctccagaccattatctttcacaccattctaaaaggaagcagagtattaatgcaaacagaaggagctctaggtagtaccaaaatcacactaacctggttgcccaatagtgaaacagctagaagaatcaaagaggagtttgaagagctgagcagaatcatgacacttttatagtctttacgggcacgccaccctgattatgaaaatttccttttgttggccatttaagggtaattattaatggtttttgaaactcaggcttaagactgcatgaaccccataattaagggcaagatccagtaaaggtccatctcgacagttgcttcatggttcagagtcgtaagcttggatttttttccccctgagattatattttccctccaatgtagaattatatttgctcacagttcacatttcataaagcttagatatagaggattcttttcaatttagttgcatatttaggctttaaaaaataactttcttcatatccagaaaaaataaatgctgccctgtgcggtagctcatgcctgtaatcccagcactttgggaggccgaggcaggaggattgcttgaggtgaggagtttgataccagcctggtcaacacagcaagacatttctactgaaaaatttaaaaaatcagccaggtgtgatggtacatgcctgtagtcccagctactgtagaggctgaggtgggaggattccttaagcctgggaggttgaggcaacagtgagccatgattgtgccactgcactccagcctgggtgacagagtgagatcctgtctgtaaaaaagaaaaaatgctgtcatagaaggacaatattacatagtttaaaaaattacggtatggccattgaagtccttctgatgtctttacatattagcagcttaaatatttgaatacatgaatgaatgaatggaagtattgcttcagaagcaggtttaagaagtggaaagaagatactcagtaatttgtggttttatttggcaaatcaatattgagtaacatggtcattttttcagctctttcattatttgttggtcctgtgtctgctttttatttctcattatccttttccttaccaaatatatttcgtgatcattcgaaaaacttgtgagaacactcgacttactcttgttcagttggaaatacttcaaactttttgtaactgccatgatttaaaattgccaaggagattgatttctactggaaagagttccatgaaataagtaggacatttccaagggacattgatctaatgctgattgtaactcacaggaaggggttccaggtggattttaagagcactttacagctttgaaacacttgtacacttccacacttatagaattttccctgactctgccttatatcacctacaaactgaggactggactattgggactgtatttctccctgatgtttctcagctctaaaattctagggccttatttacattggagaacaaatgggaaatctaatagaattccttaaaagcttcccgccagtcttgagcatttatcattccatgtgtctttgctgtcttgtatatattcttcttgtttttattatggattctttgactttgctatgcaccaatatagaatatgtattaactcactggttggagtaaagacaggcattttatttttagttataagattttacacaaaaatattctgattttggcaatgcattttaatcaagattttagaaaattgccagtgtttttacacatatgttctgttttcctgggaggaagtaggcgtttgtgcttaatcataacaagaactatctttttttaaacatcttttaaaaaatatttcagatctacagaaaagtggcaagaatagtgcaatgaacaccagtctgcctttcgactagattcactaattgcgaacatctccacatttgctttctctttctctggacagatactttcctccacccctgagtcatttgagaatcaattacaaacatccagatgcttcccccctgagcacctcagcatctgtctcctaaggacaaagacattctcctatgtaaccacaatgccattatcatagcccacgtcaaatctctccaattgttgaatagcatcttaaatcatcttttctctcaaattaccactagtgagctaaaatcaaatggggtgtttattatgttttgcatctggtttttttgtttatttttttgaagccacttcactgtgtcactcaggttggagtgcagtggcgtgaacacagctcactgcagcctcaacctccatgggctcaggtgatcctcctacctcagcctcccgagtagctgggactacaggcatgtgccaccatgcccggatacatatatatatattttgtgtatttcttgtagaaaaatacaacatgggttttgccatgttgcccaggatggtctccaactcctgggctcaaatgatctgcccgcctcagtctcccaaactgctgggattacaggcgtgagccactgcacctggcctattttttgcatctgaagaaatgattttaataactatatgtcatcttagtaacgatataggatgaaagataacatgttctatataatacacccatatattacatatgacgtgtgtatgtatatataaaaattatctctaagaaaaacttttggagcagtattggttaatagtcttctaggctacaaatctcttctttcaagggacaacttctgattagaatcagcccaatgcggccgggcacggtggttcacgcctataatcccagcactttgggaggccgaggtgggcggatcacctgaggtcaggagttcgagaccagcctgaccaacatggagaaacctcatctctactaaaaatacaaaaattagccaggcgtggtggtgcatgtttgtaattccagctactcgggaaactgaggcaggagaattgcttgaacccgggaggtggaagttgcgttgagctgagatcctgccattacactccagcctgggcaataagagcgaaactttgtctcaaaaaaaaaaaaaaaaaaaaaaaaaaaaagaatgggcccaatgctgcctattgtcagaatttatacttgtagcgaatgctagcaaaacttgaacttgaaaaacagcctgtgcggcttcttaagtttttacttgctcacttctaccagtcacatctcttgtctcttatttttctctttacccatagacttaaaagcatgagggtaaacttgcacttggaagcatgaaaaatccactaatagatactcttgtgaaacattaactaaaaatatatggagacaagtgataattacagggtgtgttcacaagagtgcgttttgaaaccagagaaggggggaaacgacaggcacaagggtggtaatgggaaaatggagaggcaaaggttatttatcacctcactgttcaattgtttgatctttggacaggcttaatttttcctaggaaagccaagagtaacatattttaagagctctgggcaccacaggcttctgtgggttattctgcttgaaggtgacagcatgcaatgtcttgaaaagcaccttcaggaagagggtacagtgttagtacctggtccctgcaaaacaaaatgggtgtgaaatgctatccatgggttcttgttatctttgatcctgaagtttaaaagagaccttgaatactcaaatgctgctttcccagaaagtatagcttgcttgtcacctgacctggtgtctaccttccctggaccttcagacaaagttcacttccaacctttgcctgggctgtgaggctcactgtcttttgggtcagcctgtgctcaccttcagcagttgagttcccagaggtctcctgaccatagcctgtgcttcttgagtgcgtatctttactatgggcagtgtgctgacctaggcacccaactcccacggcctccttaaatccttgctgcaactttatgaagtggatgctgttggtccccccagtctgtagagacatccaaggacctgctcagggtcacactgctggtcagcagtagagctgggattcaagttcaggcccagcctgcaccctcaaccaccgtgccacatgcccctcccaggagaagggcttctctgaggacaaccattgtatgttaacattaggaccacaggtagtatcacacttaagtgttaggtttacatctggaggtataagaaggttctttttctgaggtgtaagaaagttcttttcctgatgaaaatgatataggcctttgtctgttttgcactgctataacagagtacctgagactggctaatttataaagaagagaaatttatttcctcacagttctggagggtggctgggaagtcccagatcaaggtgctggcatctggtgagggccttcttgctgtgtcatcatgtggtagaaggcatcacatgggtgagagagagggaaggggactgaactcatccttttaccaggaacccattcccatgataactaacccattccaatgataatggcattaatccattcatgggggcagagcccttataacttaattgcttcttaaagattccacctctcaacactgttgcactgaggattaagcttgcaacacatcaactttggggaatgcattcaaaccatagcagctttcttttactggtggggaaaaaaacaagtttaaaagactggaaaaatacatacgtacttatgggactgctcattgatttcctcattgtagattccattctcacactacttggtgacacagcagcgcaggttggaagccagaaatgggaaataaactgcttcaggttagaggcaggactctgtcaggcaggactgggcatagtgtgtactcggcctctgagtagggcaccacccctcccttcccgtctgctgaagagactcacctgcaacttgggacatccatgagtatctcagacacccctctgctactctgtggcccactgacccatcccttagtctcccctgttagtttttaatacacttaaaacactgtgagattccaggccgggtacagtggctcatgcctgtaatcctagcactttgggaggctgaggcgtgtggttcacagggtcaggagatcgagaccatcctggctaacacggtgaaaccccgtctctactaaaaatacaaaaaaaaaaaaaaaagttagccgggcatggtggcgggcgcctgtagtcccagctactcaggaggctgaggcaggagaatggcgtgaacccgggaggcggagcttgcagtgagccgagatcgtgccactgcactccagcctgggcgacagagcaagactccgtctcaaaaaaacaaaaaacaaaaaacactgagagattccattattgagtacttgatctgaacttgacactgtgtcgaactcctcagtggagatggaaaataaaaagatctaatccttgtgcttgatgagcctacacttaatttatgagaggagatgcatttatgaaataatagaggaagttaaagctgtttgtagtaaataacggtattagattcctatggctgttgtaacaaattaccacaaacacagtggcttaaaacacatatacatttcttctggaagtcagagatataaagtgggttggcagggcagtgttccttctggagggtgtacgagagaatccatttccttgctttttccagcttctagaggccacttgcccacggccatcctccatcttcaaagccagcagcatagcatcttccagtctctctgatctctgctttgtggtcatatccccttttctgaccctgaccctcctgccttcctgttttaagagcctttgtggttacaatgggcccaccctgataatccagaatcttcccttctcaagagcctcaatttacaggctgggcatggtggctaattcctgtaatcccagaactttgggaggccaaggctggaggatcatttgaagccaggagttccagaccagcctgggcaacatggcgaaaccccatctctacaaaaaaataccaaaaaattagccgggcatggtggcatgcacctgtggccccagctacttggaaggctgaggtgggaggatcacttgaagccaggagtcagaggctgtaatgagctatgatcatgccactgcaccccagccttggagacagagtgagatcctgtctcaaaaaaaaaaaaagatcctcaacttaatcacatctgcaaagtcccttttgccacagattcataggtttcagggactaggatgcggatatctttagggtaggggaggcattattcagtctcctactatgagttactgaaaatgaattgatgatgtataggttatttatttggtaggctgagcataacaatggcattaattatgaggcagtaaggggaactggagggggcccctaaagcatgaggaatgggagggagaaggtatcttgggaaaagtagagaaggaggtggtctgtgtgtagtatggtggtgggtaggagagtggaggtgccattgacaatggccccagctagctgtggtagaagctacaggttcgaatacatgaggagggcatggctagtctgggctcctgtgtgaggtaggacctgagagccacccagaagagtttaggtttagtctgtagtgatggaggctgctggagctagcagtgcaacccaacattagggaaagtaatgctgatgtaaaactgcttgatactttatgtacaatttgaatatgacttagaatcaaaatcagaatcaggcttgaaaacctaatgagcagtaggaaaggaatgaattggagaatacttgtaaagaatactagaggaggccgggcgtggtggctcatgcctataatcccagcactttgggaggctgaggtgggcggattgcttcagcccaggaattcaagaccagcctgggcaacatgatgaaaccccgatgctacaaagtggaaaaaaaaaatgctagaggaaattgctgtatgttgcctaagagtctggaaatagaaatagctgctggtgagtaggctttccctttgtctccaggtgaaatattcaacgatgaggaacaaaaggaaagctgggcttaccagggtaggtcaggtaggtccagtcaggaatttcactgttgctaagagaacctaactcctgtagactttgttgtttaaggcacctgggatgctgtaaagtcttgaactcattacacttttattatgggctgcagaaaacatcagtaaaggttaattagtgccatatttatccttacatgctgattttacatctcctaaagctttatcacttattgatccttttttatttttctcatactatatggctcagttccaagagaggacaaatctggggatcagatgacagccagtatttaggctgaattagaggaagcaaaggcaatccttttgcaatggaagatgcgttttcctttcagatgcaaaaatctagagtattttggaaatgttggtgttaaatctaaagcatatttgagattattttctttaaccaccccagtaacaataaaatagatatgttttgaaactgtgatgttctcctgtctctcaggcttttagtggaaggaatgcaaggaacaaagacatttttgttaatttttgctgctgaatcaggttgcttataacccaagaggcagccagccatcatcatcttgtaggatccagcttgtaggatcatctgataactctgcaaggcagctggtgtgtcaggcttgggcaccatagtctctgccttgccctgaccttccgcttcctgagtgttggggttccaccagctggtgcctggcagcgttctttgcctgagtatgtgatggtgattcccagatgagatctcctaagctaggcccacacagaaccttcctgttccctccctccatcagcgacttgcctgtcaattctctccctgcttttctcctttcactgatgttcagggcaacatttggtactggagacctattttcacctgcttcccacctcttctctagcattttttgccttctccactggttcctacgctagcatgttttaatcagaggatcacagtggcatttataccttggattttctttctgtgctatcatttcaggagaaggtagcgtttattacttctgaaaacagcagggataatgtgaactaataccctagtgtaaggcctaaatactacattttactcttgatgacttaaacttgtattttcattagtaaaatacgatgtgcaaagtttaaaaagccaacagttctgaaaagcctataatgacaaagtcattaatcctcactccctctgtaccactctttagcttcttctagctctttctctgtgtttgtctccatgttgctaaataatctcatagtattctttgaggactttttagacttctcccgctttgttgaaggagtttttaatgctcttaggcagcccctatgcccactgcattttccttctctccccacctcccacccctacacttgacttttggaaatattttctggtcttcaagtgtttgtcaagttcatcccaagtaagcagtaaggcagatttcctgttctttttcttttcttttgtttacatttttgagacaaggtcttgctctgtcatccaggctggagtgcagtggtgtgatcatagctcactgcaacctccgcctcctaggctctagcaatctttccacctcagcctcctgaatagctgggactgcagcctgtgccaccacacccagctaatttttgtattttttgtagagaccatattgtccaggctggtctcgaacttctggctccagtgatctgtctgccttggtctcccaaagggttgggattgcaggcgtgagccactgcacctggcctcctgttcttagttggctaattttactctaatctcaatgcttcataccagaatatttcttgaataccaaccttgccagtaactgaacaaactacatgtaaagactcttcttgggtattgggtattgggacccaacacagtgaggaagactgaagagtcgtagtgcacttctatcaagaaattaggggaggttatccctgtagtctgcctagatggttcaggttgtctgaaacttaaatggaagttgaggctctgaatacacgtaggacttctgaatctgtggcaggtggtgcagtcttacctgatttagagaatacatagagaggccaggcatctatgtgcaactcagcttcatcggccagaagtgaatgccctatctcacctcactccagtaatacttaacctagccataattagctaaccaaagataggaacaagatgccaaggccaagagcacttgagaattgagcagtccatctaacaagggaggtcatcgagtttcttctccaccctttccctgaagtaactcttggagcaagcttgggacactgtgttcagatggctcggaaagttctggggcactgataagatcagacattttgttgggaattttttacctcagaaaattccagttgtcaaagattcctgtagagcaatatgtggcaattacggtatgggaaaaaaacaacaacaacaaatgaaaggttttatgagagggaagctcaagcaattccattagaacaggtcgactcacccaactgtagtctgttctaacaactttaaaaaagaagatgagatgaaaccatgagatcgtagtgaacagaactgagaaaacagatgaattacgagactcaccaggataggcttttcataaaaatcacctgtttctcaatttctgcagtgcgattgtgatcataaatataaagccactccggctctcaaagattgactgtctctcccacaaagcactcgccagacacaaactgagagaaaggcagggatggggaagaacctcgttctgtgagggcacagagagaggaccctgactcagctatggctcccagaaataccagctcctggagtggctgatgttggatagtggagctaagatttcagggttaagcatggtttcatttaggaaaagagggcagaggaatgggaggagattgtccaggcagagggcacagtgtgggccaagtcgccacggcgggaggaaaggagatgcagttgaaaaactcaaagaaccagcactcagggtgagaggggcagggaatataagataaggctggacggttaggctggcctgataccatgaggtcaagggtttcaagcaggaaaaatgccgcactaagatttgctgtgtgaatagaccactctgcctgcagtaggtagggtgtgctggggccatgggaatgttgagtggccagtcagtgagccattgctgtagcctgggagaaggctggagagaagtggatggatgcgggaattctggaggggataaatccacaggacttgacagagtggctatgagggagagggagcgatcaagggtgccacttaagtttccgacctacagagtgtgctagactggatgatacttctttctttcttttcttttcttttccttttcttttcttctttctttctttctttctttctttctttctttctttctttctttctttcttttcttttccttttcttttcctttctctttctttctttctttctttctctttttttggaatccctctaatggttttctataaataggttcttttggtatacctttccacagtacaagtactgatagatttgcttatggaaaatctttagggaatgcactgggcagtgggggaagagggttatcatgaaagatgtgaacaccgaagtgggaggcctcagcaatccagatctcgaagtgtgaggactacttggaactgatggtttgagtaatggcaggagggacatcatcaagatgctcctgatacattgttttataagtgatttaaatgaaagatgagaagcagatggaaaggaagtacaatgtgcagtgtgtctatgtcatgcctgtatttgaacatgatcgttggaaagactgatcaaatgttatagtttagggaccatgcttacccaatgatcattcctttaaacgtaaagcttgaaatttgggaaatgacatttttacaagatggcaaaactggacttgttttgttttctaaggtgattgatatgcccgagcacaaccctggcaatttgggaggaacaatgagactgggaataagaagaactgttttcaaaactgaaaattcaatattaagtaagtttcccatattgtttattttacaagatgttggatgtggctcatgtgactgcaggtgcccagcactctgggtggtggagactccccctgccccttccagcatcctcggagggccctgattctctctcttcccatctcccctgccctcactgaccctctgctctgggcattcttctccctagtaagcttgtcccttgggctggcctcagtagaacacactgaatgcccctccgcatttgatctgcgtgactccctgttcattgggctgttttgtgagttaccgatgctcctggagatgaacttggactgggacttggactgattcacactcagttcttttgaatccacagttctctccattacatttgaaccggttccctgtttaatgtctgtttgcctggtcttagtgactcacaaatgaacttccgagtaggagggcagttatgcacctcagaagcgtatttctctgttccctggcagccccagtgtggggagatggctcgccatttgatatttgctgatctttccactccccataaggttaattctaatttctgtggaactttttcataaattagcatattatataagaataacttattgtttaaaacaaactaaagcctttaattcaatttaataaatgtatcttgagtgcccactctgtgccatgtgcagatataatagtgaccaggacagataccagccctgccctcctagggcctcaaaacaaggggaagaaatgtgacaaaaggggaaggcagattgctaaggggaccggatgcagagagggagctcaggaattgtgagtgttcagtgtcattttcgtgaaattataagaatcccttagaatcctgtgaagttataagaattcttttttttttttttttttgagacagagtctcgctctgtcacccaggctggagtgcagtggcacgatttcggctcactgcaagctccgcctcctgggttgacgtcattctcctgcctcagcctcccgagtagctgggactacaggcgcctaccaccgcgcccggctaattttttgtatttttagtagagatggggtttcacagtgttagccaggatggtcttgatctcctgacctcatgatctgcccgcctcggcctcccaaagtgctgggattacaggcgtgagtcaccacgcccggcaagaattcttcagaaaaatgccttcttaactcaagaaagagtaagaccagaaatatgagcttttcctttaaagatgaatataaaccttctaaggaatagaaagcttcctagccagaatgaaattaaaaaaggaaaggcttcaaagtgaatacagtttcctcctttctctgcataaaaagccattgttctctaagtcactaacatttttccttacacatactatataagaactttttttcttcatgaatgttagcaattctgtagctttcaggtgtcttcagattctatgaaactttgttcaagtaattgcctacgtgacaaaaaatggttggtgaaaaattaatgtcctaaaattatatctattgagaaagattcagtgataattgtactaagtttttaaaaagagcattgtactcaatatagttaaaaatttgatagatataagtctgatttaagatttttcttggccagtcgcactggctcacaccagcactttgggaggctgtggccggcagattgcttgagcccaggaattcaagaccagccttggcaacatggggagaccctgcctctacaaaaaatacaaaaattagcctggcatggtggctcatgcctgtggtcccagccacttgggaggctgaagcgggacgatcacctgagcccaagaggttgaggctgcagtgagccatgatggtgccactgcactccagcctgggtaaaaaagatttgtttttcttagtgctggatgtggtgtaatgtgcctgtagtcccagctgcttgggaggctgaggtgggaggattgcttgagcccaggagtcggagaccagctgggcaacatagtgagactccgtctcaatttaaaaagtaaaatttgtttttcttcacagtagacataaaaatattgatgatttgatgattttcatgaatcttaaacacagcagcaaagcttgttttgaaaaattttgaaaacaactttattgagatataatacatcatataatttgtctattagtagtgtacaattcactgattttattttttattttttatttttttttgagacggagtctggctctgtcgcccaggctggagtgcagtggcgaaatctcggctcactgcaagctccgcctcccaggttcacgccattctcctgcctcagcctcccaagtagctgggactacaggcgcctgccggctatttttttttgtatttttagtagagatggggtttcaccgtgttagccgggatagtcttgatctcctgacctcgtgatctgcccgcctcggcctcccaaagtgctgggattacaggcgtgagccaccgcgcccggcccaattcactgatttttttagtgcattcacagaattgtgcaaccatcaccgcaattttaggatattttcatcacctcctgtagaaaccctgtgcccattagctgtcaccatccctacttcccgccagcccctggcaaccactaatctactttctgtctataggtttgcccattatggacatttcatgtaaatggaaccatatgatttgtggtcttttgtgtctggcttctttctttcttttttctttttttgagatagtctcactctgttgcccaggctggagtgcagtggcatgatctcggctcaccgcaaccttcacctcctgggtttaagcgattctcctgcctcagcctcctgagtagctgggattacaggcacccactaccacgcctggctgatttttgtatttttagtagagacggggtttcgttggccacactggtctcgaactcctgacctcaggtgatctgcccaccttggcctcctgaagtgctgggattacaggcgtgagccaccatgcctggtctgtctcctttcttctagcataatgtttttttgctacatccacattgtagcatgtatcagtacttcattccttttaatggccaaataatattccattgtatggatagaccacattttgtttatccattcctcagctggtggacatttgggttgtttccaggcaacaatttctttaattttttctccttaattttttaaaaagtcctttttctaaagggaaagaaaagtatgttgccttaaatttaagttgtgcttcatagtttccaagaagtatgtgatatatgaacttgtgccctcccacttgtgcagcactgtcttccacaggtctccaaaaaaggctgtgccagagataagaatgtgaccactgtgcaaggctctactgagtggcatacaaatatcaaaacatatagcatgatagtgtttttttgttttcttttgttttttgagacggagtttcactcttgttgcccaggttggagtgcagtggtgtgatctcggctcactgcaacctccgtctcccaggttcaagtgattctcctgcctcagcctcccaagtagctgagattacaggcatgtgccaccacgccctcctaattttgtgtatttttagtagagacggggtttctccatgttggtcaggctggtctcgaacccccaacctcaagtgatctacccgcctcagcctcccaaagtgctgagattgcaggcatgagccgccgtgcctggccgatagtgttttatgaacgtttttttttctcctagtcaacatatttcttttgtagaattttatgtatttatttatgtttttataagctggtacatttcttttgtaggattcccccatcccgtattggcatatttcttttgtagacttttttccaagtcagcacatttttgcaagaatgctatgaacaaaatacatttgcctacattgcctgtgaaaacaattaacaattttgatagaaagcattgaaatgctactcatttttttcatttaaatttgacttataggccagtagttacaatgcttggattaaatagaaaaacaggaaagtaaagagtcctctagtaaaaaataatgccttgaaatagggtcacagcctaaagatattgatagccgcagtggatggatgactagagtgagcctttttttttttttttctctttttgagacagagttttgctcttgtcacccaggctggagtgcagtgacaccatctcggctcactgcaacctccgcctcccaggttcaaccgattctcctgcctcagcctctcgagtagccgagagtacaggcatgcgctactatgcctggctaattttttgtattttatttgatgtggggtttcaccaccttggccaggctagtctggaattcctgacttagggtgatcctcctgcctcggcctcccaaggtgctgggattatgggcgtgagctactgcacccagccgagcctaacttttatattcaagaacaattcctctttttttcttaataacctgttaattccttaagggttatgaaaactatgaattcactttttctgaagtggagattataggtttgaattgatttggacaaaagtactggtaatgattatttgccctacttataagcagtgtgttcctagaagttcccttcctgtgttctatgtgttgtcttcatctgcaaaggccttttcctataaaagggctaatgacagtgtgtgtagaattatcaaagctgattcaagggtccttagaaatgagacattttgaggaagagggagagatttgttaaaggattcaaaataattaccctgatttgatcactatacattatatgtattgaaatatcactatgtgccccataaatatgtataattattgtcaattaaaaaaagaaagaagattttttctaaactgtattatctataatcctgtatctgagtattaactgcatatccatggtcttttccagacttcatcaagattagtttttatgtagtcttttctggtggcatcactttttcctgtatctggtcttcctgtctatgatctgtgcatatagtatttaatcgcgttaaggaggcatattctgctgattcatttcctactgataaaacacttcacatggtttctggcattttgttagaaaaatgctgaatcgaacatcctgacacagtgttttcgttcttttgaatatttccttagtatagatttccaggagttggattattaggtcaaagggtatgaacacttttatgactgataattctgccagactgttggaaagaagggctgagcaaggtcataatgacattcactgtacttgtgtccctgctttccctagtctttttggtaggattatttttcttcttgctgtattaatggaaacaaaaagagccctatttctgttcattgctaaaaagtgaaaacgttttctacttcgaatgttgatttacttgtgtatatagtgcccaggtctgaagtctttattaggacttaactatgggttggtaaactttttcaataaagggccagttagtaaatatttttggctttgtagccattgtggtgtgtaaacagctacaggcaaatatgtgagtgaacgagcacggctgtgtcccagcaaaactttatctatgggcgctgaaagttgattccatatcattttcatgtggcatgaaataatattctttgatttaattttttcaaccaatttaaaatgtaaaaaccattcttagttcaagggccaaacagaaacagtcagggggatcccatgactgtgggctgggccatagtctgttgaattctggtccaaacaagaacctttcagcctgggcaacatagtgagaccctgtctctacaaaaaaatttttaaaaaatcagccaggtgtggtggcatacacctgtagtcccagctactcaggaggctgaggcaggaggattgcttgagcccagggagttgaggctgcagtgagccatgattgtaccaccgcactccagtctgggcaatagagtgagaccctgtctcaaaaaaaaaaaaaaaaacaaaagaaaagaaaaagaaaaagaactgcatgttgaatgaactccacggatgaggcagtgagctgctcccatcctaggcagagttgaaggacatcatctccccacttctctactggcttgcatacatatcctattttatgacagagaataggactaagggggctttcagaagccgtttgatctaacctccttatttttcagctgaggaaatggagggctgagagatgaagtggcacacagttgggagagtcagaaccagggcttggacactcttcccacgttattttctagtcttctaataaaacatgctgtcctggctcccccatctagtgctataatcactctccaaaatgtaactcttggccaggcatggtggctcatgcctgtaatcccagcactttgggaggccaaggcggccagatcacttgaggtcaagggtttgagaccagcctggctatcatggtgaaaccttgtctctactaaaaatacaaaaattagccgggcatggtgtggtgtgtgcctgtagtcccagctacttaagaggctgaggcaggagaatagcttgaacccgggaggcggaggttgcagtgagccgagatcatgccactgcactccagcctaggtgacagagcaagactctgtctcaaaaaaaaaaagaaagaaagaaaaaaaaggtaactcttgaaacacccaattgttagactccttgatgctctaccttcaggtctgtatatttagttgcatgtaaattatacctcgattttttaaaaactcatttttctccttttaaaaaagtttttaattttaaaaaatagagacggggtttctctttgttgcccaggctggtctttaactcctggcctccagcaatcctcctgcctcagcctcccaaagtgctgggattacaggcatgagtcactgtgtctggccttaaaaaagcttatactatctggaaagttagatagtagggcttgtctccttatagtgatgctattagttgattaattaactcattagacgatttttgaaaagcagggagaagtggcacagtgtgggtaagtcttaagtggggtgctttgaaaagtaagaaatgtagaatgaggagtggctaaagatggagggatcaggctcaggtgagaggggagccaggggaacactgaggaactaagttaatagacggttttaagactccaaaaataaactttattgttttgcttgtggctctcaactgagagcacaagagatgggaacataataaagcacaaagaaattcagacaaggttcagagctcattcagggatggccaacaacttgatagtgtctctaaaatattacaagaccctggccttaatttgcttggtcaagtcccagatgtgttgccaagacatccagcgagggaggcaagactttgtgttgaatgtggtttccaaaccaaactgccacctgctagaaagaacatgtttttcagaccatttcagttcacatgtttgaatactgcacaatctggtgtgtgtgaatttagtaggaatgctagccccaaacttatttatttatttctttattttagagacagggtttcactgtgttgtccaggctgaagggcagtggtgtgatcgtagctcgctgcagcctcaacctcctgggcccaagcagtcctcctgcctcagcctcctgagtagttgggactacagccacatgccaccacgcctggctaatttctaatttttttttttttttgagacagagtcttgctctgtcgcccaggctggagtgcagtggcatgatcttggctcactgcaacctccacctcccgggttcaagcaattctcctatctcagccacccgagtagctggagctacaggcgcccgccaccacgcctggctaatttttgtatttttagtagagacgggtttcaccatattggtcaggctggtctcaaacttctgacctcaggtgatccacccgcctcggcctcctgaagtactgagattacaggcatgagccactgtgcctggcctaaaatttttgtagagatgaggtctctttgttgcccaagctgatctgaaactcttggcctcaagagatcctcaatggccttttgtacactttttcaataagggaccagatagtaaatatctttggctttgcagccattgtggtgtgaaagcagctacagacaaatatgtgagtgaatgagcatggttgtgtcccaacagagttttatttatgggtgctgaaagttgatttcatatcattttcacgtggcatgaaatgttattcttcattttgtccagccatcaacctaatttaaagctcccaaattctctatgccctccaaaccagcacccaaacagttagggagcacttacccttagaagcaggggaatgccacaaggtggaagggtgcagagaagacccacaggctcgaggagagagaggagggaagaggtgggccttgagcacggggttgtactgtgggctccctatagggaggtgtatctggtccggttaagaatgcaacacaacacagggccgggcgcggtggctcacacctgtaatcccagcactttgggaggccgaggtgggcggatcacctgaggttgggagtttgagaccagcctgacttacctggagaaaccccatctctactaaaaatacaaaattagccaggcgtggtggcacatgcctgtaatcccagcaactcgggtggctgaggcaagagaattgctggaacccgggaggcagaggttgcagtgagccgagatcacaccactgcactccaacctgggcaacagagcaagactctgtgtcaaaaaaaaaaaaaaaaaaaaatacaacacaacaaacttgaaggaattaggagcccagggcagtgcagtttatacaactggagactaggacctggtgatttccggagttctgtgaagctggccctcatcctcagagcagatgacatgaggacagtgaggtttgatgcaggcagataacagctggcagaggaggccagggagagctcctcaggttgatgccggcaggagcatgacatgactctggcatacaagacacgagtgaagccttctggacctggcaggtggaaatggaatgctttaagaaaaggcttcattcctttcagggaccttctctgcatttcctcgtattaaagaagaagaacttgactaaaacgaccagttctgctttaatgtaagggaaaaagtgttttgtttggaaagaacagaggcacgaggcccattaaaaagatattgagtgagacccagtgctgggagtcccggtacagtttatggcattgcaaatgcagagtggttaagtctaaaatttgaaagagctgaaagaaatggggagaagttttcaggggctagaaaaatggcttttgctttcttgtctcttatcaaagcattgatatggaaaaacagcttctggctcctggtgtgattagattaggaagtttaaaaattaaaaccaaaaccaacattgaatgttcgtgaaacattagagcaggggaaaaaaaagaaaaaccatgtaaaaaaaaaaaatcctcgactgagttaatgaggtaatttacataacagtttaaaagaggtcgcccgggatttagggaccctgagtccatgccatggtaatttgtcattgtgctgagacacaaattccagaggagcacggcagggcttcgtgagagctgcataccacttggcgagcctccccgcctgcccccagagcccaggtccacactgcagggtggctgtcttcttactgcttcttgccttttactggggaaaccattcgctaaagcgtgtttgttaatatggaggttcataggtctgggacatagcacctttcatcctaacaacagatggcattcctgccccctctctagacaagcacttgtcctcatcacttcaccgaagggaactagtggagtggttaagagcccagcctgtggagccactgctcaccagaggcccgttgggcctcagctctcagtctctggctatgtggagctacttacccgcaccacgcctcagtttctgcatctgaaagacagagataagagcgccgcctcatggggttcttgtgagggttaaataaatgatatgcgggagcccttagaacagtgcctggcacagaaaaggcactgtttaagtgtggctgatatttgagagcattgacctgtgatcttctcaaagcttggggcaaacgtcggttagtgacctggcattaagaatgaggtcccactaggggagtgggagggaagaataggctttcccttgctcttgcaaggttatttctattctgtctttcttggctgctagctccccacttgccaatgcataagatctaagaaaagagatgccaagaatgaggtaagaatactaaatggaaaacaaatgaaagtgatgaaaggtggggtgtggtggcttacgtctgtaatcccagcactttgggaggccgaggtgggtgaatcacttgaggtcaggactttgagaccagcctggccaacatggagaaaccccgtctctactaaaactacaaaaattagccaggcgtgatggtgcatgcctgtaatcccagctacttgagagactgagtcaggagaatcacttgaacccaggaagtggaggttgcagtgagccgagatcacaccactgcactccagcctgggcgacagagtgagactccgttttaaaaaacaaaacaaaaagaacaaaaaaagtgatgaaaaagaatgtaatgctataatatagagttaaaagcaaagacgcatttttcaactcagatgtattatactaaaaaattgagataaaagcagattaggaagataaaattagggaagggggaggagtttagatactaaaagaaatgaaatattttataaaaattggagaaatgacattctaaaattcaaaagtaagaaataaaggagaaatataggagaaagtaaaggagaaataaaggagccagctgtggctggctgcaactcggtgctttctgcacaccagtaattaagacattgctctcatcacccctaggacccagccaccattttgcacaaaagaaaggaatcttagcaaagttaagtcactcatccaggtcacttgttagaaagtcattgagctgactctttgaccacctcactgtaccaaacggctggaccttaatcaaagaagaggcagaaaaacccaaacagctcccagagctggatgctgccctcactgagaatcctgagaaaaggttttgcaggtttcgggggtgtctggtgggtggagagcagggggtgcagaaagcgaagaccctaccccaggcctcttctgaaagccagtctgaaaccgcgggtttagcttaaggatagacacaagcactgagtcagttttgcactgagcatctaggccagtagggcatgcagacaggcaggtgtgagaaatgccacagcttaagctcaacaatcagcagcagctacactgagccttagagttagagaggcagtaaggagtggtagggactgtggcaaatcagcaagcatgtgccccatcaaagaagtgacttccacagctggtagttgtatcaagaactgtggattcactgctgccagtcttctaaattttcaagaaaatctggaaatctggagttttatgtaaaatctcctgacgtttaaatgttggcaacttatttacatttttaaaatattgtgtgtttgccagcactctgcaagcgaaatacaacaaatatctgcaccctgggcagcctcttaggatctttgaattagataagcactgaattagataagcatcagcaaattcttgcacatacgagagggctctggtccttaaaatgcctaattagcagaaggcatggttgcaggtagtcttaaaagtgaagtaaattaagacactggtgcaaaaaggacatttgtgtaaaagcaaggcaattctaccaagaaaagaggtaatgaagcccagcaggtagtggttttacttttttattaagttggtgcaaaagtaattgcggtttttgccgtcgaaaataatggcaaaaactgcagttacttttgtaccaatgtattagatgctatgggtgattgcctttagccccctggaaataggagatatggcaccgggggaaagataaggatcagaaggtatagaatgggagtggacagctatgtgggtgatagcttccaggggagcgaatgtgggagaagaaaagagggtacagtcttgggcaggggtccccagttgaggatgatgaacaggtagatggggcaaaaagtgcctggaggagcagaggtcacagaaggggaagggtggcagctgaagacagacctgctggattttagagagcagttctgtaaagtcacaggaacaaaagccaggttgcaaagggtgggagtgggaggtttgaataaagggtgagtcagagcaagagggcatcatggacaagagtggggctggatgatttttgttttttattttaaaaatttttaattgtggtaaaatatacataacataaaatgtaccatcttaaccatttcctagtgtacagttcaattgtgttaagtacattgcattgttgtacagtctccagaactcttctcatcttgcaaaactagaaactatacccattaaatagcaactcccccttcccctggcccctggcaaccaccattctattttctttctttcttttttttgagacagagtctcactttgttgcccagattggagtgcagtggcatgatcttggctcagtgcaacctctgcctccaggttcaagcgattctcctgcctcagcctcctgagtagctgggattacaggtgtccaccaccacgcccagctaatttttgtatatttagtagagatggagtttcaccatgttggccagcctggtctcgatctcctgacctcaagtgatctgccccccttggtctcccaaagtgctgggattacaggcatgagccaccatgcctggcctctattttctgcctctttgggtttgactactctagatgatatggacaggagaccgggaaatactgggcagaagagggcgattctctggcaaaggcccgaccctcaagcctggaaacctgtggccctaaataagaacaagcattcctgttttcacccccaaatgttgccttttggcccgccatgccccctatcctgtactatataaaccccaaaccccaggctccatgagcagaagagtggtgtggcagagaaggagagaagagaaggagcatctgaacatggagaggagtccggctggggaccattggagaggagattggctgctggacggccaaactccaggggaagatcatcttcccactccatctccttcctccccatccatcccactgagagccacctccaccactcaataaaatccccgcattcaccatccttcaagcccatgtgtgacctgattctttctgaattccggacaagaacccaggcaccaagaaggcactgagctggttaacacttaagccatctatggacggcagagctaaaagagcactgtagcaagcccagtggagtttccggagtcacaggcacccactcctagacactactgtgtggctggagcccaaaagtgttcgccctggatcctgcacctgcccgtctgtgtgctccccctcccataagggatttgagtgcacacagtggctgaacagatgagccatacctctgttgcacgtcctgtgaggggggtcagggaactctctcgttttatcgatacctccttgaagtagaatcatacagtatttgtccttttatgagtggcttatttcacttaacatattgtcctcaaggttcatccatattgtagcatgggacaggatttccttcctttcgaatgcagaataatattccattgtgtggatggatatgcacattttgtttatccattcatccctcagtgaacatttgggttgcttccaccttttaacttgtgtagcttttttggggggatattttggctctcaaaaggacaaaggaaaaaattaggttcagttgctaggattactcacatgagggtaggcatgggcaggaccattaaacaggtaaaaatatattatgtatgaggcagtatcttacccagtagcaaattagagaaagagatggtataatttggaaaggtggtttttgtttctgataacccttttatccacatttttggtgtctttctgcctgcattgggagtgctttataggtcctaagacttttgttggttttctttctctaaagctttgctgacatttacttcttaagtgaacattttattttgtctctaaaaagactaggacagaaagaaagactgagtcactttgttgttgagattttcccccattcctaggatcatttcatggcacctgtgacagaggactgctcttaggaacgtggtgtgtatacctctcagtttctgactctactcctagattttacattcaacagtatctagcattttgccttgtcgtggaatgttcttatactgcactttcaatgttggtgtagattagttgattctaaccagaaatgcatgtcagggtgacttgtggtgcatttttaaaacccacgtggccagacactctcctgagagtaatcaaatcagaatcgatggtactggggtacccgggctccagaatgagtattcttagttttattttgttttcgggatgttctcaaatagaatttcattggtagcattctgaactgattctcaacatagagtttttaaggaaattttaatttttcctttttcacaggtatagcaatggattaattttgtaaattcatttctgatagatttgtaagcaatgaagaaagattttgaatgcataaaatagaatttccaaagttctgaaaacatgtttcattgtatatcgtatctgttgtatgttgatttcattcaacaattcattattgagtacctgcttatctgctaggtgctggtcttaagaattgaggggatgggccaggcgcggtggctcacgcctgtaatcctaaggcgggtggatcacgaggtcaggagatagagaccatcctggctaacacggtgaaaccccgtctctactaaaaatacaaaaaattagccaggcatggtggcacacacctgtagtcccagctactcgggaggctgaggcaggagaattgcttgaacccgggaggcggaggttgcagtgagctgagattgcaccattgcactccagcctggcgacggagtgagactccgtctcagaaaaaaaaaaaaaaaaaaaaaaaaaaaaaaaagaattgaggggatgactgctgggtatatacccgaaaggaaggaagtcagtatatcaaagagatatcgcagtcccatgtttattgcagcaccagtcacagtagccaagatttagaagcgacctaagtgtccatcaacagatgaatggataaagaaaatgtacttatacacaatggagtactattcagccatagcaaagaatgagatcctgtcatttgcacagcacagatggaactggagatcattatgttaagtgaaacaagccaggcacagaaagacaaacatcgcatgttctcacttatttgtgggatctaaaaaccaaaacaattgaacccatggagatagcagaaggatggttgccaggggctgggaagggtagtggggggctggtagggaggtggggattgttaatgggttcaaaaagtagaaagaatgaataagacctactatttgatagcacaacagggtgactatagtcagtaataatttaattgtacatttaaaaataactctaagagagagtaattggattgtttgtaactgaaaggataaatgcttgaggagatggataccccattcaccatcatgtgattattacacattgtatgcctgtatcaaaacatctcatgtaccccctaaatatatatacctactgtatacccacaaaaatttaaaataaaagatttaaaaaaataattgaagggtcaggtccctattttgtctgttacctcgtatagcttatgttctagttccattcatttggattttattgtctggagataacaatatcaatcactgaaatggttcgctttctgttctcagtgcttcccatattttgatttatttaatccttacaactctatgaagtaggaactatcataatccctattttatagatgaggaaactgaggtagagaggttaaataatatgcccaagccacacatccgttaaatagtacagtggaatttaaagccaggaagtctgacttcagagtcactacactcccctacccctttctgtcacctctgagatatcttagcaaatacagagtctgccttaagccaggcagcagtcagaaaccatgcagtttcaaacattctcatgatatcctgctagtccccttgactcgaagatacgattccttatatcctaatttggagatttgtgccattttccccatcatctcgagaaatgttggcagactctagtattggatttacaaatcacctattgtaatgaagggaacagaaaagaaattttggactataggaggaaaagatcaatgtcaaagtcagaggtcataggacacttaggatcctctgaggcaacttcctgatgcttctatgttttctttctttttctttttctttctttttttttttttgagacagcatctcgctctgtcaccaaggttggcaggttggagtgcagtggtgacatcctggcttactgcaacctccgccttccaggttcaagtgattctcgtgccccagcctcctgagtagctgggattacaggtgcgcaccaccacgctgggctaatttttgtttagtagagatggggtttcaccatgttggccaggctggtcttgaactcctgaccttaagtgatcctccccctctcagcttcccaaagtgctgggattacaggtgtgagccaccgcgcccggccttcctgatgcgtctgtgttttctaactgtatgttattgtgctttatttcccatttttattttaatttttatgaagcagttgttttagtttaggctgtcctgaatgacccctgccagtggtatgttcgcattctctcaaaggaactccctgcccccactattccccttttttctaaaatacataccttaaatattcactatcattcatatcgtcaccagggagctcagtctatatggacagaattgcaaatagaagttcagctgtgatcattgatcgtacaaagttatatgagaatacaacccatttgtgtttgcttgatccaagtcaaaagctcaaacaagatgcaaagaaagcatttatttggtttttcttggttgaaacatcctgttccagcctcatgatgtctttgagagtctgataattccctgcctgttgaactgagcatggcttctgattctgttggagtttcagcatgacttccagcactgttatcttcttaacccttggctgtgtacctgggatctgcgttttgagggctagtgctgtaggaagagtctctggtcctctcagactgctccagtgctggagcccacttggtccctggaccatcctgcttctccacatgctccagtaggggcattctttttattattattattattattattattattatactttaagttctagggtacatgtgcacaatgtgcaggtttgttacataggtatacatgtgccatgttggtgtgctgcacccatcaactcatcatttacattaggtattctcctaatgctatccctcccccaaccccctaccccccgacaagccccggtgtgtgatgttcccaatgggagcattcttgagaggtgtttggtgatggatccgactcctattcacctgacaatgaagtcactaggcagctcgttgatcgccgtgcccatcgccacactggtcatgcccagggtgctgtgcttagctgcagtgcctcagctacgtaggcatgtttaggcagctccccagatgattctcagccacacacccctggttaagagctgttggcatagatgtgctatcatttaatccaccagtttgtctattcttgatgctcagcttgcttccaattatttgctattaaataattcagcagtgcacatctttgtggttaagtctttgtcctcatttctattttctgggataaattctgagaagtccaactgtaggatcataggataggtacatttttaaggtggagtacattttgaatgtggccagtacggtgtgaaaatctggaggcagctggtggagtggagaaagcattgggccaggtgtgaggaagcctgggatcaagaacaggctccgctgcccagcaaggcagggctttgggcaagtctcttccctgcccccagttttgttttcttcctttgtaaatgaggctcattacaaatctgcactgaagcgatagtgcagacatggccgtctcttagtcctgcaggcaggtgtatataaggagggcagatctgctggattctgtggtggacttgtgtagcatctggcttccttttatgcaatggtgatggcttacttgagaagtgcttcaggttttcaaagaagctatcgccatcttctattagaaaagaagaaaatctagatgactatatggagtctattagttcatttttagtcctctgatagatagatagtgatccaggcacttgcctccacaaagcatcatggatgtgcttgtgaagctgcttactctaatattaatctcgctcttgtatctttacagggaaactttatggtgatgttccttttatagaagaaagacacagacatcggttcgaggtacggctttcatgctgaattactggggaatatggatgcttagtgtgaggaacccagtgattacaagctgagcctctggaaaaggtgtctagcctggtggtattcacagggctcagagaggaccaaatttcccacagtctcccacttccagaggagatgggcggcgaggggacaggggtggggagtggggggcggaggctctcatgtttttggctttccaaaggcaaaatctttatgtacctgcacatggggcctatcaatgccctttgttactctaactgccatcttctagatcatgataaggccatcatttcttatccttagcccccaccctttattttgccaattttgtggaaaagaggacttgaatcttctgagaaggaaccaagtgccttttgggatgggggtgcatccctgggtatcagggggtgattagtttgagaacctctttggaaatttacattaagcttgaggcttagcgtcacatgactaaaaggagttaattgttgaggttgccacatgagaaacatagatttctcgaaatgtagatcgtctatgccaggattaatgagtgtgtcaattacgatgcatttgactgtgaagaacagaaatccctgcttgttgtcactcaaatcaccctaaacattaaggaaatttgttatctcaggcaccaggttgtccagaggctggacaggctccaggcatggcacaaccagggctcctgttgtctctgtggttatctcagccctacccttgtctgtgtgtctgcttcgtcctttagctggtctcccatatagttcccaggtggctgccagcagcatctgggacaagaggcatctctccagacagggaaatcaacttagattacctgcccacctgtgaactagtagccatttttcagggcaatgctgaacatcagtgggcttaaacctgggttcttgcaatattcatcttccaagagggctgggtttattatgtttggcttagaccagttagaaccagtttctggaatgggacagatggagtttcctggttcatataggggtggagtggataccaggacaagcctagggctctgttttgaaggaggactcgtgggaatcaatgccaagtaggcaatgaacagtgtcactatgaccaaggaacataatttggtacatgtaggacatttttggtcttatttccattgggaacgggcccaactggtgggataaaaattattgagctgctttggctaagtggcaatgagaaggtgcaagaactggtacgtacgcaatagcgtagccattcattcattcacacctattttgcatctggtatgcattggagatggaaaggggaaagacagacatggtctccctcttgttagggagcttacattctaatggagaggacaaaaaataagataacataataattacagattaaatcctgtattggataagggacttgtatctaaaatatatgaagagctcttacaactcaataatgaataattgcaaatgatatgaatagatatttcttcaaagaagatgtacaaatgactaataagcacatgaaaagatgcccaacaatcattagtgatcagggaaatgcgtattgaaaccacaaaaagataccacttcacacccactaagctggctataatcaagcacagacaataataacaagtagtggagaggatgtggggtaactggaaccttcatgcattgctggttggaatggaatatattgcagcccctttggaaaaccatctggaagtttttcaaaaagttagacataagaattaccatatgacccagcagttccactcctagatatatacccaagagaaatgaaaatgtatgtccacacaaaaacttttatctgaatgatcatagcagtaatattcataacagccaaaaaggcagaaacaactcaaatgtctaccaactggcgaatagataagcaaaatgtggtgtattcattcaatggagtattattcagtcatagaaggaaatgaagtactgatttatgctacaacatagataaaccttgaaaacatcatgctgagtgaaagaagccagatacagaagcccacatattgcatgattctattaatataaaatgaccagaataggcaaagctatagatgtgggatatagattagtgattgccaggggatcgggtcagggtgatggggggttgggggatgaggttaaagggtacagggtttgtttttcagttggttgtggtaatggttgtacacctctgaatatacgaaaaatcatttgtgtatttcaaatgggtgaattgtatggtatgtgaattatgtcttaaagctgttaaggaaggaaaaataatgacaatacgagaactggtataattttaaaatgtagaataaaagctctgaggttaagattgcaaagaataggtgagactccaccttaacttttgacagggaagcactttcactgaaggagaggctgaaaaggagtccttaggtttgggaaagggctaaggtgagatgggggccagaaagggccacaagccaggtcatcaagttgccatctattaggatattttagtagaaaacttgctccaagcttctctttagagcttttatgtaactgcatgtaaagaaagcattggggttagtcacaagggaaataggatagttttaatcttcaagcaaatttgtgattcggggagagatagggaagtacacataactcaagggaagaagcaaacatggaaatggctataaataactagtctcaaggttccaggtcagaatgtctgggttacagggcctactttttgaatctcacctttgggtaatagaaggcacctcctagatttaggtgctgtggttacattttatatctgaggttcatcattagtttaaaattggctttgagcattgaatatagacattaactactagttagaggatcactgaaatggaaaacccacccaactgatgaaggacctggtatggcagctggtattgcactgtggcccataaacacttaatttcttgttttgcaggtaaaccctaacctgatcaaacaatttgagcagaatgacttaagttttgtaggtcaggatgttgatggagacaggatggaaatcattgaactggcaagtaagtgggctcttcatttttgaaaaccttccaataacttgcctttttgtggaccacagactaatttgagacccagttttttttgcattctttcttttcttctctcctttgaaacaaatatgtaactacaaagtacatgaaaaaaacagactgctggctgggcatggtggctcacgcctgtaatcccagcactttgggaggctgaggttggcgaatcacctgaggtcaggagttcgagaccaggttggccaacatggtgaaaccccatctctactaaaaatacaaaaattagccaggtgtggtggcgtgcacctgtagtcccagctactcaggagactgaggcaggagagtcgcttgaacccaggatgtggaggttgcagtgagccgagatcgcgtcactgcactccagcctgggtgacagagtgagactttgtctcagaaaaacagactgcttataatcctgatcattttggagcctattagtctgactccaccataaaatgatgtattattccaagtctaccagttctacaagtagtatgcttccttaccaactcctctctttctgaggctacttctttgtgccagcctctaggttaggtgctctgggaaaggcagagtggcactgttgagtggcaccctgcctgctctcctcttttgagaaagaatagccaagtgccacctcatttttggtgactgatgttgatttctgttgcttgagggacctggctcctctcctgcctttctccactgtgctgggtggtcaagcacgggtcagtcatttaacttctgaacactaatcactgcccccagagttgtttttaagagcaaacagaacagaaataaaggcatcagaattgaggaagaacaccgaagttgttgttagtaaccaggctggaacacccgtgagcacataggcacaaactacacatttactattgatgagacagaaggcagtgttcttctcagtcagctttgcaaggacatggtaagctcatggtcacagctggtctcagctctttgtcttgatgttctagcccaggggttggcaaactactgcctgtgcaccacgtccagcctgctgtttacagccagcttatgagctgagaatgatttttacattttttaatggttaaaaaaatttaaaaaagaatactgtctgtgacatgtgaaaagtgtatgccattcaaatttgcatccataaataaagttttattggaacacagtttaggggtagaaaggtgttatctgtgaccttcttacccatcataagggtcatgaccaacaaccctataacaagacaggttgacaagagaaaagcataacaaatttatttaatcaaagttttatgtgacactttagtcttcaggaatgaagacccaaagacttggggaaaacttcatttgtatgcttaggtttgatgaacagtggacagccatgtagcaatgtgattgggcaaaagggcatactctaatggtaatagactgacagggaaacccagaaaggcctgtctgctcagattcttcttggcctttctgtgtagcatcccattcccccaggtctagagcaggactcatctggaatgagggtcttatgacctactttcaggaaaggtaggtcagataatttatttatagccagctttcacatggaaaggcgggggaaacatcacagtgaccttcttgctttggaggtcttcccagtcaccttcagttcaaactactttagggtagtattttctgagctccgacaacagcaacactcattcatttatgtcttgtctatggctgcttttaatttttattttttttgagacagggtctagctctgtcacccaggctggagtgcagtgccatgatcatggcttactgcagccttgacctcttgggcacaagtaatcctcccacctcagcctcccaaggagctgggactgcaggtgtgcatcaccctgcctggctactttttttttttcttgagatgaagtcttactctgttgcccaagctggagtgcagtggcgcgatcttggctcactgtaaccaccacctctcaggttcaagcaattctcctgcctcaccctcccgagtagctgggactacaggcatgttccaccatgcccggctaatttttgtattttttagtagagatggggtttcactatgttggccaggctggtcttgaactcctgacctcgtgatccgcctgccttggcctcccaaagtgctgggattacaggcatgagccacgacgcgcagccaattttaaaattttttttgtagcggcaggtttttgccatgttgctcaggctggtctcacctgggctcaaggcctcttccttcctcagcctcccaaagtgctgggattacaggcatgagccaccatgcgcagccaatttttaaattttttttgtagcggcagggttttgccatgttgctcaggctggtctcacctgggctcaaggcctcttccctccttagcctcccaaagtgctgagattacaggcatgagcaactgcacctggcccatggctgttttttatgctaccatggcagagatgagtagttaagaaagagaccttatggctcacaaagcctgaaatatttaccttttatagaatattggccctttacagaaacatttgctaactcctgggctagactcacacatatacacttcatttaactaacttgaatttaacattttcacgtgcctccttgacctgtttgtgtatttggatgttgtgttgccacttccatctcaacttatttaaaactaaatttacatggtctcccaattagttcattctcctgtttctgttaagatatcatcaatatccttgtccagggtttctcagccttgccactattgattgacatttggagtggaataattctttgtcgtggaggctgtcctgtgcactgtatagcaagcttgtccaacccacagtccgtgggctgcatgcagcccagggtggatttgaatgtggcccaacacaatttcgtaaactttcttaaaacattatgagatttttttgcaatttttttttaagctcatcagctatcattagtgttagtgtattttatgtatggtccaagacaattcatcttcttccagtgtggcccagggaagccaaaagattggacacccctgttgtagagtgtttggcagcattcctagcctctactcactgccactatcatccctacctcccacgttgtgacaacccaaaatatctccagacatcatcaaatgcccctggagagccaggtgcagtggctcacgcctgtaatcccaacgctttgggaggcgaaggtcggaagatcacttgaagccagaagttcgagaccagcgtgggcaacatagtgagatcctgtctctacaaaaaactaaataattagctgggcatggtggttcgtgcctgtggtcccagctacttaggaggctgaggtaggaggttgagcctgggaagttgaggctgcagtgagccatgatcatgccactgcacttcagcctgggtgacagaacaagaccctatcttaaaaaaaaaaaggcaagtccctggggggcacatttggtggagaaccattctcctagactatcaggctagaaatttcacatattagctcttcttccccttcagatcccaactagcagtgtgttgtcaagtcctgcagattctgcctctggaaagaaagctggtgtttagaattgcactgccatccctagaacactagtcccagtgcatgccaactccagctcacacttgtcctcaatctccttcctgcttccaagccatcccttctccaatacctcctaacaagaacagaactctgcagtgtgtgacactaatttgttggataaaccactctcatatattgagtactaagggtgtgcaggatactgtaaaaatggtaccgtgatgttccagaacctgcatttccagcctatatgctttaggctccagataaattggattgcctgtgcgtcttctaacctccctcttctttctccgtcttagctcatatcactattctccatttcaaatgccttttctctgtctcttttcctttttgtctctaatctgttcaagtacttccagagtcccgagcagaggggagaattgaagtccaagaaggctcctttgaacgttgtagcattttacctagacctgaaagaaggaaagcaatggacattcagtgtgcacttactggatgcttgtcactagacctcttgctagggactttgcataccttatgtaactaacaaagcagatgatgctattcccactttacagaggacaccggagtgcaaagaggttaaatgacatgcccagggccatccagctagtcctttgcagcaagagcaaacccagttggttacctccttctgccaccactgctgtgggatttcattgtttctcttgttttcacgttctacctaagatgatcaattcatgcctagagttttgaattagaatagtaagtacgcatttccaggagtctttctgatggaaatgcccatcatttagaattaaagtgtggatcgctgttggtattgaagcctcttaaatcttcctagcatgtgagaaggcagaaaatttcttaagcaaattactatttgtttactttgtttaagtacttattcacttttaattcttctggttgtcattattgtcatcaaatacttagaaggttctttcatcataaggatttagattcccactggggctttcaaatttcatgtggattgaaaaggaaatgagagctgctataaaaccttgcagtttttaaaagcggactgcaagcagttattaaggaaaattccccagaagattttgatcttagataccccttggaaacatatccacgaatctccactgttcctgaagggttctgagaggaacaacaaagcttgagattaatattatataatgtcagaatttggtttaaagcaatcaacagcattattttaaagataattttatctaactgatagaacatcatcaaaataaaaactttttactttctcctcatattggcatagaggattttttggataaagtgattcagagcaatgatccattcattcacatagtctgtccctggctattacatgattacattgctcagcatctgtctgtagtgatacaaaagcacagttactgtctgcttttttttcaaagatgtccctagatgttatgcagtaagatttattgtctcttaaattttaagctacattgcttaatttcttctctaagtgcggatgatttctctgcgtttcttgagggaatacattcctgggagaaggtggcattccccttatcaggctttcttacctgcatattcctctaattcaaggaggtttcttcttagatgtagaggatttctacactggatttttctgggatcagagctgtcctatagaactcactggatttttctgggatcagagctgtcctatagaactcactgcaatgatagaactagtccaccctatccaatatggtagccactagccacatgtaactttgaacatgtttcaaatgctgaattaatgttaatgaatttaagtagctacatatggctagtggctaccattttctatagcagagctttttttttttttttttaataatttcaactttcattttggatgcagggagtacatgcgcagttttttttgtttgtttgtttttgtttttgagatagggtctcaccctgtcacccaggctggagtgcagtggtattatcatggctcatggcaacctccacctcctgggctgaagcgatcctcccatctcagcctcccaagtagctggaaccacaggtgcacgccaccacgcccagctaatttttgtattttttgtacagacagggtttcaccatattgccccggctggtctcgagctcctaggctcaagaaatctgcccaccttggcctcccagagtgctgggattacaggcatgagttactgtgcttggcccacgtgcagatttgttacatggttatattgtgtgatgctaaggtttagggtatggatcccatcacccaagtactgactagagtacccaacagatagtttttcaactcttgcactcccctttccttcctccctctggtagttcccagtgtctattgttcccatctttatgtccataagtacccaatgtttagctcccatttataagtgagaacatgcagtatttggttttctgtttccgtgttaattcgtttagaataatggcccccagctgcatccatgttgctgcaaaggacatggtttcgtttttatggctgcatactattccatggtatatatgtgccacattttctttatccattccaccattgataggcatctagttgattccatggctttgctattgtgaatactgctgccatgaacatgtaagtgcatgtgtcttttttgtagaatgatttattttcctttgggtatatacccagtaatgggattactgagttgaatggtaattctggtttaagttctttgagaaatctccaaactgctttccacagtggctgaaataacttacattcccaccaacagtatgttttcttttctccacagccttgccagcatctgctgttttttgacttttttaataatagctgttctagcagggctttaaatgattaccttaagaaagtagacatttgcattcaatcatcatttccttattactgtagtagtagctttggatctttgctggtaagtgatgggaatttgtgattttgaattccatactagattttagatcatttgataaagcacctcattgaaagctttaaagttatatttacttccccctcttaaacttattatattttattatctttagtttgagtcatagccagggacaggatatttgaatgaatggatcattgctctgaatcactttgttcaaaaaatgctcagttttgtggtgctatgagtaatacccaacttaaagctgtgactagaaaagcaattgtcctcgttgggttcccaagggtagcccaatgggttgatattgtgctggtttatcccaggggacacttaccctgggaaaggagaagaccttgcaggaaatggcctgaagccacctaaagaaagaaagacccagggttagcctaaagtccaagggaaattgaaccaacataaatctacaaagtgccttcaaaaagcaggcagatttggggaaagtggaattcttcttgccattcaaaaatttttgcttgactttgctcactctgacaccttccgcacataaaatttccaagatgtgttttacaatttgaaattccacgaaggaatggatggatagtgaaagtaactggctgtaatgataacaggttaaagaatcatcttaccatttaatgagttttcatattcaaagataagaagatctttaaagcagttctcctgtttgtctgctttaatcgcatcgtgattgttctcatttcagatcatccttattttgttggtgtccagttccatcctgagttttcttctaggccgatgaagccttcccctccgtatctggggctgttacttgcagcaactgggaacctgaatgcctacttgcaacagggttgcaaactgtcttccaggtaaccagcttactgctcttagcaataaaccaagatgcatagttattaatatcttagggtttcttacaaaaattaataccactatagaatttttaaatgtgaagaatcagtttttttctcttaaacataattttcttctctttgtgaaaatgatttaatcacacctacggtagtaatgtgtcagctttccaaatcgtgatgacactgggtattattttagaaatttttttcattttgataagtgaaaagattgtcttttgttgattctttgattaatatatatgaatttttatatgtttattggctgtttgttttatgaatagtttgttcatatcttttcttcattttggtattgtattattttccttactgattggtaagctctttatgtataaaggtcattaatcctttgttaggctgcaaatatttttcaaagtgattttgctttccttctaaattgttaatggtagttttgttctccctaaagagtttagtccttttttatgttttttaaaaatgtatgtagtcaaatattttacttttgtggcttctgcctttactctcatgcctaacatctttccttatggaaagattatataaataataacccctgtgttttcctctagcatttttctggtttcaatttcatagtttaaatctataatctatatggattttattttcagtgaaacctgtgaggttgggatttggctccctacttccctgccaaattgtcaacgagttgagtaatttgactttgtttcagggatttctattttgttccattgatgattttatctcttacacctgaacctttgccatccttttcattttcatagcattattataaatcaggaccttatcgatcctactcccaccattattaacatgtttagtgtgttttgctattcctccaggcaaactgttatttatttattattttcttagagataaggtctggctctgtcacccaggctggagtgcagtagcacaatcatagctcactgcagccttgaactcctaggctcaagaaatcctcctgcctcagtctcccaattagctgggactacaggcacacaccaccatgcctggctaatttttttaatttattatttttgtagagacaaggtctcactatattgtccaggctggtcttgaattcttgacctcaagcaatcctcctgccttgacctcccaaagtgctggcattataggtatgagccactgtgcccagcctgtacaatgctttttaaaaatcaagtttgaataaaaaattccttagggattttaaaattaaattaaattaaattaatttatttatttatttagggacagggtcttgctctgttgctcaggctggagtgcagtggagcaatctcagctcactgcaacctccacctcccaggttcaagagattctcctgcctcagcctcccaagtagccgggactacaggtgtgtgccaccatgcctggctaatttttgtattttttagtagagacagggtttcaccatgttggccaggctggtctcgaactcctgaccttaaagtgatttgcttgctttggcctcccaaagtgctgggattgtaggcgtgagcctccgtgtcccgccaaaatttcattacatttcaatactagtttggggagagtttatttttctttcttctcatccaaggatatcgtacctaataacttgaaaagcagaagcaaccatccagaatatcatagactttggtaggggttattaccacaataaccagatatatgttgttcagaagattaccactgccaaccctcattctggcaaacaaccctcgcagtgttgctgttgagggctggcaggatctgtgtgtggtgtgcacgtgtgtgcttgttacacaaccctacttatttgtgtcattacctgctaggagaagctcacagctctctagcatttcctttcaccatgtgttcatatgggaacagcttcacataatttgcactttgggcatcttactgtattgatgttcacccctttcagtgcactgactttcaaactgtgctctcggagctggagtctgggctgctgcgggagcaggccatgggggctctgggctccttcctgcttcagctgagcagctccactttatctggctcatgtgccatggttctgcaagagagatttcatctgaagaagagcttcctgtgttctgagactgcacagcttatgccactgattggacatcctaatgtggtcccatgtcagatgtgggctgtgaccctttgcagccgttttacaattcccgttattttagattctcacactgaaaggaaggtgatagtgggacaagttagatggctgggagaaataactcacttataactatctggctgtttgcaaataccaactaatatacaaatcctgtctggctcgtgtggactgcccacctgtgtgttgtatggcctgccaattcccgcatggcgggtggtggtctctgggtagagcttccagcggggtgtggtggctcacgcctgtaatcccagcattttgggaggccgaggtgggcagatcacctgaggtcaggagttcgagaccagcctggcgaacatggtgaaaccccgtatctactaaatgtacaaaaattagccagacgtggtggcacacgctgctgctagggaggctgaggcaggaggagcgtttgaacccgggaggcagaggttgcagtgagctgagattgcaccactgcactccagcttgggcgacagagggagaccctgtctcaaaaaaaaaaaaggcttcctagtagtttctgaaaaaactgactgattgctagtgactcctgagtgagatatagtatgtctcagagagaaggaaagacctcttaaccaagctctgatgctggcattggaattatagctgactagtaggcttccatgacactgagggaattcctacgtgtatcaaccacaaattggtacattccttaaggacagccagcatcttatttatctttatctccctggctcccttacacacaggggttgtttattacccattaaagtaatgaatgcaggtagcaggggagtcaaatcttgacacatttcagagagttttctgacagagggtggtgactatgaattaatccagtgacagacaccaggattccagaggaaccttgcacttcaactcctctctgcccagctccatgagattagtgagctttgaaaagcaaatgactactctgatgccaggctctaatgtgagctgagttggggctgtatttctgacaaacaagattactgcttgtaatcaaccctaaacaatgtgacaaggaatatgaacactagaataatgacttcctttcccagaagttggcgctgatgatattcaattgtatggcacgtgtacggccaatgtctttaaagcatggagtgtaaaaatccttgcctttgagttaagcgtacctgaggtgtaacctccgcattctgcctagcggagaatatttatcttttagggcctgggaagttgcagtaagactattattttgggatttacagctagtgagctaaattctcagctacttcattatctacagaatggcagcagttaggaagaccaatttcacctggttttaggcttgtagtgggcagttcaagggcacaatagcttcaggacagtattttttaggtttttatgagctatttaaaaatacatgcaaaatcaaaataagagtcttgtttagggggtccccccaagactgcccacactttggtgatttgctgaaagtaatcagaatatagctgtactcatagctaatatttatttatttatttatttagagatggagtttcactcttgttgcccaggctggagtgcaatcatgtggtcttggctcactgcaacctccacctcccgggttcaagcaattcttatgcctcagcctcccgagtagctgggattacaggcacccgccaccatgcccagctaatttttgtatttttagtagagatggggtttcaccatgttggccaagctgggcttgaactcctgacctctggtgatccgtgtgcctcgggctcccaaagtgctgggattacaggtgtgagccaccgcgaccggccttatagctaatatttattatggtggcaaagtaaacatgcacagcaagatcagtaatgggaaagataagtggagtctggagaaattcatttgcacgtttcctatgatctctctcctgtgataagtcacgtcgagttcgccttccttccagcagtgaaaatgcaactatgcctatgtgatgtttctgcccagatgagccagtttgaggctcagagtttagggatatttcgagggctggtcacataggcattttctacctagcaaccaccaaaattccagatgccagagggaaagcaggtgttcaccatagatcacattgtataaacagcctaagcccagcaaaatgaccttatcagttagtaatggagcacacattccgaaagccatgttcccggacaccagccaagaactaaccctgcaagcaggccctttgaaagatagcagcctcaagcctgctgttaactctttttttacacgagtctaactaacaaaccattttgaaaataaaaaaatcaaatgggaaataatggtccattaaataaatcattgcaattctttgctgatctctctcctctggtgtctaaacaatttgtctcacgtataaaaggcaaccacaaatttgcatggtcttgctgacacataatgtaaaagaatgagactgcttcatgtaattataagaaatacatttcaggagaatatgaaggtgcttgtaattgcaagttttctttgtttgtttgcttgtttaaatctagaaacagagcatctaatctctttctggaattcctttttttttttttttgtttctcaggctggtctcaagctcctgggcgcaagcaatccgcccaccttggcctcccaaagtgctgagattacaggcatgggccaatgtgcctggcctgaggcctagaattccatttttaagtaaggagagaaggatcagagtctaaagttcatagattgttttctagcatgtgtgtctctgtggctgcctgcaaggctcttgggagcaatcactacacaccaagtttaggcacaacttccagtttttatttgtcagatcagagtaaaactctcttccttggacagtgcttgatgtatatcagaaagcaaaaacttagatggggttcagtttgcagttcacagaaatgcagctttttgggaaacatatttttaagtataaaaccagaatcttgagtcatttgagtagcattttattctagttttggaactttggattccatgtctccatccagcaattactgtctcttgtgcagataaatcatctttttgtggcaaaacaggaagcagcgtggtacaaaaacaacaggagggaaaggtactcagtgattcactgtatttgcttgactgtttcagaccaaacccaaaagccgaaactactttgtaataagagagtctttaaaggaagtacacacctgaagccagttccttccgtttcctctttcctttgtgtgcccctaggatctaagtccattctctcctctgtgcttagcccttccctctatatttgttgagtcctggcaacagtcagggtgagaaggaacccatttcattcaccattgtctctggtctctcttctgtgacaatatatcggggttttttcctgctaagtaacatgctgacttctagcctgggatggttttgttttctgttaacttctacatgtagcattacagaaaatttagaaaagagagagagagaaaaaaaaagcacccacaaacccaccagcctaacataattactgtgctcattttcaaatatttcctatgagcctatacctgtatatgattctttctgtggctgtaataatagtgagtgtatctatctatctatatagatatatatacacacacacccacactcttttattttgaaaacttgcaaacctacagaaaagatgaaagagtgatacagtgacggtctggagatctcctttgcaaaggaacatttttctccattttggttttatttatttatttatttatttatttatttatttatttatttttgagacaagtctcactctgttgcccaggctggagtgcagtgtcatgatctcggctcactgcaatctctgcctcccgggttcaagcaattctctgcctcagcctcccgagtggctgggattacaggtgcccgccaccatgcccggctaatttttttgtatttttagtagagatggggtttcaccatcttggccaggctggtcttgaactcctgacctcgtgatccacccgcctcggcctcccgaagtgctgggattacaggtgtgagccaccgcgccaggccattttggtttttaaataccaaaaatttgaaatgaactagggctcctggaagtaatggttgattccaggactggggcaggaaaagtacaagatgagcctggaacatattgctgtatttaaagcaaggaacagctgaaaatgaaaggggtatgagttttccaaggtcaaagaagccagcttgaaagggcacccactggccttattttggacaatttgaacatcaaaaagaacaatgacagtattagattataacacatttcattttctgaaattccatgagtccataataatactaagaaaatacaaaagcaaagaaaaaagaaaagccaattaaaaatgtagatgtcatctctgatgtaataatggattcaaataaggatcatcagtggatgctaaagccactgggtgaaatttgtaagaaacagaatattcatatgttttcagaatagcaccataaattctttattaattacagaagtttgtattttgaacttaacacttcatatgcatttttccaagttgcatgaagttcatttttaatggctgcacacttcaccattcactcaacacaccccctatgttaaagcttattctatcccagccactgtgctgggtgcttgaataagtgcttaaataagaacatgttccctgacctggggactcatcaggtagtataactgttctctaaattttgggaggtgacagacttccaagattgtgatcaaagctgtgggcccacttcctggaaaactgcccaaacataccactttgtagtttccttacattcatacccccaatgctacccccgtcccctgcatccatagactttcttctaggggtcttcagctacagaccttcccatccaggaaagggcacagacctgcaagcgcacagtcccagcagtgtgggaaatgctggcattagagcttgttctctctttcgtggttgtacccagggaatgctcccaggttgccaggattaactaacattaagattaatatcttcctgcaagtggtaccatcacccacacagtgtgacctggctggactcccctggggaagctcagattcctcctccctcatccccattgctcatagtcagcaggtgctggcaattcctgttgttggaattcactccatcttttgtctattttctgccatgctgcaagggagtatggcccggagtcaggactctagctgtcaaccgagttcaaactggctcttttacttcccagctggctgtgaccttgctcttctgtgcattgctttctttataaaaaggggatggtaatagtccccacttgacatggcagaaatgaagattaagtttcacactaaatgtaaagcactgagcgtagtgcctggtctatggtaggaacttaaatgggaattattatgatgatgctattattattacttttcctttagttccagtatctatctcttgcctactgcaaagcctcctacttggtttctctgcctccagcttgcttcctcccaatccgtcttctgcggttggaatgatctccccacattattttggaacttaaacccccccccccccgatggcttcccttggtttataggataaaatgcacacaaatccatatggaacagcttgcagttccctgaactccccagagggttttgcctgttgtgtcttgatacacattcctgacctgcttagtgagaggggaatagggatctatatcctattagaatggttgttcacggactcgttaggtgaacaaggtgaatcggaggtgacaaggtggcgaatcggaggtgaattattaggtgaattgcaggtgagagtggctccctccattgttcacagagggtgcatttcactctcccaggcatgcttctcttacgttgcgtggctctgctctctcttggacttggagagcaaggtactcttttcccttgcacaaatccgacattctgtttccagcactgcttgaaacttggaatcgctttgtttcaaacttggaatcactttgctttttgactttgagttgcatggttgatgttgccaggggccattcttgcaccatgtggtgcaaaaatattttacttctgtggggacactattgacaagtagggtagatgctatggattttacttctgcgtctgctgcttattgagtaattttgtccaagtcactactcctaaacttgctgattctcctccttagggccgctgtgagggacagttgaggtggtgctttataaactcaactgctatcaaaatgccactttccccgctttgttacacttcaagcaaaagtgaactgaaattaacaaaagattctattttgctttcttttgaactgttcttttaaacattttagaaaaccattcacccctgtgattgtttgacttcaactccataccttgagatattttttagggtaaattattgttaatgaaccacatttgagtacaccttcccttggggtgggataaacgttggttaaaaggtgcttttaaccagatcacggtgcactgcagtgtggatggtgtggtgccagacacgaatggaattaatagtactacagactaccgtgtgcttttaccaccctgcctgggtggtattctactgtttactatgaaatataaaactcattcaaagcagactaagtttttgttccattgttcttatattttatggcttccaggggccctttatgaaggaaataagtatagtagtaatactgctttggggaaaactgtgttcatgacaatctgtttttaaaacatgctgtttcacaggaaacggattttaatataaagtattgtaaggaactcatgcatgctgggaatcctaactatgccattaaaatctttaaattccaaccacctctttctgttaatggagaagaaatggtttaacagctgccttggggtagcgtaaaggtgggctatatgaggcattgctataccctttccctagcaccttggaatatctgttttcttatgttgggaatttattgggagccagaagtccttgacaagcaaacttcactatgacaaacctttcgtttgtcaagagccacatgttggctgggcacagtgggtctgtaatcccagcactttgggaagccgaggcgggcggatcacttgaggtcaggagttcaagaccagcctggccaacatggcgaaaccctgtctctactaaaaatacaaaaattagctgggcatggtggtgcattcctgtaatcccagctacttgggtggctgaggcacaagaatcttgaacctgggaggcagaggttgcagtgagccaaggtcacaccactgtgctctagcctgggtgccagagtgagactgtgtgtcaaaagaaaaaaaaagggggggggtgccgggtgcggtggctcacgcctgttattccagcgctttgggaggccgaggtgggcggatcacctgagtttgggagtttgagaccagcctgaccaacatggagaaaccctgtctctactaaaaatacaaaattagccagacgtggtggcacatgcctgtaatcccagctactcgggaggctgaggcaggagaatcgcttgaacccaggaggtgaagattgtggtgagctgagattgcgccattgcactccagcctgggcaacaagagcaaaacactgtctcaaaaaaaaaaaaaaaaagaaaaaaaagaaaaagaaaaagaaaagaactacatgttgaccattgtggtaaagtcttgtcagtatagtgattcctctgtgttgctgctggtgattttggttttgtcttgcaagaaatggtaccataaaatactttttaaaaagagagttttcatgatttgggaggcacacgcatgcataagagatatttgctgtgattttcattaatggtagatagacctttaaaaaaaacttttggccctttatttccttctcctgtctaattgccctggcaagaacttccaacactatgttgaataggagtgatgagagagggcatccctatcttatgccagttttcaaagggaatgcttccagtttttgcccattcagtatgatattggctgtcggtttgtcatagatagctcttattattttgagatacgtcccatcaatacctaatttattgagagtttttagcatgaagggttgttgaattctgtcaaaggccttttctgcatctattgagataatcatgtggtttttgtctttggttctgtttatatgctggattacatttattgatttgcgtatattgaatcagccttgcatcccagggatgaagcccacttgatcatggtggataagctttttgatgtgctgctggattcggtttgctagtattttactgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccaattcctccttgtacctctggtagaattcggctgtgaatccatctggtcttgtactctttttggttggtaagctattgattattgccacaatttcagctcctgttattggtctattcagagattcaacttcttcctggtttagtcttgggagggtgtatgtgtcgaggaatttatccatttcttctagattttctagtttatttgggtagaggtgtttgtagtaatctctgatggtagtttgtatttctgtgggatcggtggtgatatcccctttatcattttttattgcgtccatttgattcttctctctttttttctttattaatcttgctagtggtctatcaattttgttgatcctttcaaaaaaccagctcctggattcattaattttttgaaggattttttgtgtctctatttccttcagttctgctctgattttagttatttcttgtcttctgctagcttttgaatgtgtttgctcttgcttttctagttcttttaattgtgatgttagggtgtcagttttggattttcctgctttctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaccttacaagggacgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatcccaatcaagctaccaatgactttcttcacagaattggaaaaaactactttaaagttcatatggaaccaaaaaagagccctcattgccaagtcaatcctaagccaaaagaacaaagctggaggcatcacactacctgacttcaaactatactgcaaggctacagtaaccaaaacaacatggtactggtaccaaaacagagatatagatcaatggaacagaacagagccctcagaaataacaccgcatatctgcaactatctgatctttgacaaacctgagaaaaacaaggaatggggaaaggattccctatttaataaatggtgctgggaaaactggctagccatatgtaaaaggctgaaactggatcccttccttacaccttataccaaaatcaattcaagatggattaaagacttaaacgttagacctaaaaccataaaaaccctagaagaaaacctaggcattaccattcaggacataggcatgggcaaggacttcatgtgtaaaacaccgaaagcaatggcaacaaaagccaaaattgacaaatgggatctaattaaactaaagagcttctgcacagcaaaagaaactaccattagagtgaacaggcaacccacaaaatgggagaaaattttcgcaacctactcatctgacaaagggctaatatccagaatctacaatgaactcaaacaaatttacaagaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagatatcatctcacaccagttagaatggcaatcattaaaaagtcaggaaacaacaggtgctggagaggatgtggagaaataggaacacttttacaccgttggtgggactgtcaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacagtagcaaagacttggaaccaacccaagatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccacatattctcactcataggtgggaaattgaacaatgagaacacatggacacaggaaggggaacatcacactctggggactgttgtgggttagggggaggggggagggatagcattgggagatatacctaatgctagacgacgagttagtgggtgcagcgcaccagcatggcacatgtatacatatgtaactaacctgcacattgtgcacatgtaccctaaaacttaaaagtataataataaaaaaaaaaacaaaaaaaaacttttggcgaggcatggtggctcacacctgtaatcccagtactttgagaggctgaggcgggagtattgcttcagtccaggagttctaggccagcctgggcaacatagtgagaccccattcctacaaaaaataaaaataaaaggttagatgggcacggtggcatgtgcctgtagtcccagctactcgggaggctgaggtgggaggatctcttgagcccagaggtggaggctgcagtaagctgtgatcgtgccactgcactccagcctgggtgacagagcaagaccctgtctcaaaaaaaattttttttaaggaaatgacaaggaccattgcatggtgactgtagtttgctttttaaaaatcattattcatttgtttttagatcagtactatccaatataactttctacgctggtagaaatgttctataatctgcactaccatatatggtaggcactaggcgcacatggctactgagcacttgaagtgtgacaggtgcaaatgaggaatggaattttaaattttatttcattttaactgatttaaatttagatagccactgtggcttgtggctaccatattggacagtgcagtttaaaaattttcccctcttcttgggaggccgaagcgggcagatcacttgaggtcaggagtttgagaccagcctggccaacatggagaccctgtctctactaaaaatataaaaaattagctgggcgtggtgatgggtgtctgtaatcctagttactcaggaggctgagacaggagaattgctttaacctgggaggtggaggttgcagtgagcccaaatcactgcactccagcctgggtgacagagcgagacacactatcttaaataaataaattaattaaaaatttcctctcttcaaatgtaacaagacacatagggacatgtctgtattttataccacttcataaaatttaacatgcaagactctaatatatgataattcttccctgtgagaaacgtgtgtgtgtgtgtgtgtgtgtgtgtgtgtaaaagattgctgaaaaagataggttagtcctaagatagagctggatatcttgaattaaatgaaaatatacccagacacatctagcttatgacttaagtttgttctgtgtgaaacagaaatgaacccggcatagagtagcgctcacggcgcatatgcagcacagagtgcactcacattttattgcatgtgcaagagccactgttggtctgcattcagatgacccacattttatttctagcagttgttttttattggcagatgaacgtcctaaaatcagcaagttcagcagtaacgtatattttgataattgtgttcttgagtgtcatggtttgttttattgtcctaccgccagtctctgaacatatgaaagacaattagtgaacccagtcattaagcttggagatgaataaattcaagctgaacttcattttgttaaactcagcctgtgccatttggatgtgttggcagagcttggggcagacagccatcagataggaaatgagagctgttagattagaaacaggcccgcccaagtccacttgctaatgtgggtaggaaattatacttggcataggaaacaatcctgaaaatcatacacttagcagtttttattggttctttatgtttccatgactgtttgaggagataccaagttatgaatatataacccctatcaatagcaacatcttatgtttttatatagttttcagagcaagtttatacagtttcttttgactctcaaaacattttggtgagtttggaggtattattgccattttttctagactcagaagtcaatgacttgtccaaaggtacgtggctcataaatagtataaccaggagtgtggggggaagatatgagcccactgtattcttccccaggcttagagatggggaaggaagtgggtgtaaaatctggcacgcaaggaaatgaagttccctcagtcctttggcccttgtcacttgcgttaggggacatgccctagtgggtcctgctgccctacctgtggcacagcttaaaccctaccctgtgccccgagctagtataatggggattctggcttcaccttgaaggatctatgtgccaagtaagtcacttgaacgtccttgaccttcatgtcatctcagataggaagttgagtgcaacttccaaatcccctttcttggctaattctatgacacaaaatgttgcatagaacgaggaaggagtctccatttgagcagggagagtgcatgaataggatgtatcagcttttttggctgttgttttttttttcctccaaatattcttcagttattcctatgtaccagtagaagggatttctctgaactaaagtctaagtaggaggtatctttctacttgattggttttaaggatatgttgttttatatgtttatctaacatatgttgtcttttctgccagttctgaatcttctatctcctctccttattctagtgctccccccacccccgccaccacctacgctgtttttgttcaaaagccagagaaggaagtgagcatgcaaatcaggaaacagattgtctttttgcctatgcagatttgtctgtgattttgtttatttattaatattcacttagcatgtttagagtaaaatcttccttttctagtctatcagcatagggtttctccaattgttccctttcctcaaaaaaaaaaaaaaaagtaaaatttcacctgttagggaattcagactttttttttttttttttttgagacagagtcttgctctgtcgcccaggctggagtgcagtggcgcgatcttggctcgttgcaagctccgcctcccgggttcacgccattctcctgcctcagcctcccgagtagctgggactacaggcgcccgccaccacacccggctaattttttgtatttttagtagagttggggtttcaccgtgttagccaggatgatctcgatctcctgacctcgtgatccgcccaccttggcctcccaacgtgctgggattacaggcgtgagccaccgcacctggctgggaattcagacttttattgctataaatcagcaaaagtttggccaagactggggatgggtcaggcatgaaacatttccttgtaatatcatctccatagatcagtagaactctagtggagtagatcagtgtgctgatttatttggaactgagtaaaaggaaccacaaacagaccccacagctcagagtgaaagttgagttgcagagctatctcatggggaaggggtatttctaaggcaacccaacctggcgatatttgtcaataattggtcctattttgaatactttctgtgactcaaggtaatcagggcattccatatatttctaattttgaaatttgcataattgtgaaaattatttctccaactcttggacctatgagaatgttggaagggaaaactttcacgctgctgacctaaaatcataatgaaaacatgatctgaaggagataacatttcaaggcaagtgtagagagtgcgttaacattttttatgtcactgcagggtgttttctgggtcttgagccaatatgcacgtcttagtcctcatgaccaccaagttcaagctcctgtgcaatttgctgatcgtagatgactagttcctccgtaatgaggaggtgctgtgattctcaagcacggaggccagcacagatctggatctagggaggtgctgtggtccttaaaacacagagccaaaagccaaactgcagctgaaaagaattacagcatttcgctaatgtaatcagggatacacagctgtgttcactgttctctagtcctttcatgttgctagaggggagaaaagatagtttttcctctacccatcataggttcatggccaaggccctgataacaaaaaaacagattaacaagcaaaaagcatacagttgggcacagcagcaggtgcctataatccctgttatagcaggtgcctataattccagttacttggaaggctgaggtgggaggatcccttgaggccagtagttggagactagcctgggcaacagtgaggcaccacctccccacactcacacacacacacactccagccccatttcttaaaaaaaaaaaagagacagagaaaagcatacaaatttatttaatgtaagtattatgggaaccttcataaggaaatgaagattcaaagaaacaggtaaactctggtctttctaaaacagacctgatgaagagtagagagtcatggagagttataatagagcaaaaagagtgtgatctcatggtaatatagtaggggaacttagcaaggcctgtttattcagattcttccctgggatcctgtgtcttcagagataaggatactcgtttcctctgggtatgggggttgggggtacctctcacctgagggccttttgacctgcttggagaaggtcagaaaatccttccggggtgttatgacctgcttcagtgggggaaggtcagaggaaggtcagagagaacttcttgcacatgctgtctcaaattccttccgcttcatgcaatgtatatgtgggggctgttatggttagagtcataatagtctaggtcaggggttgacagactttttctgtaaggttagagagtaaatatgttaggcttatgagccatacgcaatatgccaagatgccatattttggggtagtgtgtcctgaactccctcattgccaaaggaaacagttgtcatcagaagaatgaagaatgaaaaaaacaaactgaagatccaggtaatatcgtatgctatgttattacattgaagaacaaattgacatcagtaggagtaggactaagtgatgctcaacctcagatggactgaggtttagtccctagtatgacaagagtagattcacagaaaataaatgggtccatcaactcaggctttcattttaaatcagtttgttaatataacacctctagtagaaagcaagcaatagttaaggtggcaggaaggcaatctactttcaaggcttttattaaagtttagaaatgatcagtggtcttcagaagattataaatttcagtctaaactgaaatgcgtttttaattttctgaataagtaacttccagtttacgatgaaaataagtgatcagtttctctgaccaaagaaagaggccattgcatgtgattggactgacctcttcctgtggtgactagaaagtgctaaaagaatattctttagtattttctctcatactaaggggttaatatggaatgtgtttgaaattgcaaattgaataattgtccaggttttttttttataccttgctaaattagttcctcttttaatctagtgatagatacagtgatgccagtgatgacagcttttcagagccaaggatagctgagttggaaataagctgaaatgaatacatgactgggaataatggggactgcctgtgagggtaagatggaatcttcgaggattgttcatttctctcatggacaagctgtcatcttggtatagaggcgggtattataggactcgcctcacaggatcttgcccctttgagatactcccatttgactggcacagttagcaggacacgcatgacagcccatgacagagttagtgtttggggaaaatggaatgcaccttgggccaggaaaaaaaaaatataagtacacctataaatgtatatgtgggggctgttgtggttagagtcatcatagtctaggccaggggttgacagactttctgtaaggtcagagagtaaatatcttaggcttatgagccatgcagttcctgcggcaactactcaattctgctgttgtagcaggaaagcaaccatagacaatatgtaagtgaacaagcatggctgtgttccaataaaattttatttacaaaaacagtttgctgatccctggtctaggccactcatagaagagcagatttccttggatttgtataaaataaaattaaaataaaataaaacataaaataaaataaaataaaatagtatttgatttctttgtagggagatgcaagagacaggcttagtgtccaagggcagcttatttttccattgctctattatgcactattagagagaataccagcctggatagcttcagtaaatttatgctcagtggcagatagtgcctggattgccctaggcattatggcaggccttgacttgtataagctgttctttagcagagacagcagcttttggaagacttgtaaagtgttcattgctttcctgtgaggtctcttcatgtttatcagggaagatgcaaagctgtgtctatttagttttgcctcaaacatggagaccctttggagcaagccaaaatggtgcaaaggttagctggagatattgaaagacttgtattattcagttcctggtgttgctaatatttatattcttttcttttaagcctctgaaataattgaaggcaagatgaaggaactatctgaagaaatcactacactcttagagaatccctctgttctccagcaaacatgggatgtaaagcctcacagggaatctgataatacatacttctgtcaaccagaaccagaggggtagttttcttttccctccagaggcagcctttggtacttaaaatatctgtagctgattaaatttttcccaacaacctcactggggagaaagtgtgttcatgttttgtccagcggatcaggatgttaggatgacgagcaagagtccaggtcactgtgcctttgctgtgttgtatggaaaggatggcagggaacatgctgtaagtaattttgagtaagaaaatgagtcactgtgttacctggaactcagccacagatttgtgtgtggtccaagatcattgcagtttctcaccctgtttatttcctggtaaaagtaaaattgaataggtccaagacttgggggtggcaagtaaggctttgcctcaggcacaaaatttaagggggctccaaaaaactcaggaatcaagatcagcaatacagtctgagtatcccttatgtgaaatgcttggggctagaagtgttttgaatttcagattttggaatatttgcatatacatgcgatatcttggggatgagactcaagactaaacatgaaattcatttatgcttcatatacaccttatatacatagcctaaaggtaatttgatacaatattttaaataattttgtgcatgaaacaaagtttcgactgcattttgactgtgatttctggcatgagatcagttatggaattttccacttctagcgtcatgttggcattcagaaattttgaaattttggagcattttggattttcagattagggatgctcaacctgtatatatattttttaatcgacgtgaaattcacgtaacatagaattaaccattttgaagtgaacaatttggttgcattcactgatgttgagcaaccaccacctttaactatttccaaaacattttcatcactccaaaataaatgcctgtacacactagcagtcactccctatcttcccctccacctgtccgctggcaaccactgatctcctttttatttctgtggctttttctattctggatatttcatataagtggaattacacaatatatgtggtcttttgtgtctggcttcttctgagacagtaggaaggggggcttggctttggctcacccccactagagcattttttcatgcattcccactgatcacaaaacccatactactacctcattgacaccatacctgctaacctcgaggctttagtcatacaaagaaaatggcctttctgtattgttcttctgtgctctcataatgcttaaccatgtcttttacttaaacaattccaggaactggccttaggagatccaaatagggaaccaagattgcagagtgtcccatcttgggagggaatgctgaataattaattgatttacagccttgttgccgctggccagaccaccaggtggcccattactcgagatgatcatcacaaccagatgatgctaacctatatcctctacccttcgcgtgctttgtctgggaagtcttttggccccatgtcagtttctattgcattgagagcccaagagcccctggtcagtcaggcttccatttagcatggcgtttgcaaggtttacccatgttgtagcatgtgtcagaatttcattcctttctatggctgaataaaattccattgtatgaatatac

SEQ ID NO: 5511 - DNA, 124346 bp, human
gggtgacgggagctgcctgtgctggaggaatcactttttaggcgcttgttttggaccattgcacaaacccgggtgcaaaccccaagctcaccagcgtgagtgagctgggccagcagcagggaggagaggggaaggtgggcgaggagggcgccgcgcaccccgaggcccgtgtgggcggtgggaagatcccgggggcggctttggacagccccggcagcgaccccttccccagcccgacaggtgagcgccaggccagccgcggggtggagcccgccgtgcccaccggccaccctccccggtgctaccaccaccgcgcaggtaacttcccttctgggcctgtcccagacccccagggcctcggcgcccgggccatccctcgtccccagggcctctccgccctgcacccccagccccggtgcacttgtggggccgggctcctttgtccgctctctgatggcgccggctccctgcccagcgctgagtcgggtccggccgccagccccgcgctcgcagacctcggctgccgggtgtggcgcggggactggggaacgctggcccgtgcccagtgcggttggagcctgtcccgcgcgtccccgggacgcgcttcttcccgcctccgcccgcgccagcgcccgcacccggatccccacttctcccggccctcgggagccaggagagccctgagatggcgttggcggaagtgaagccccgagcgggggtctgcgaggctggtgatcagcgccggtaacatggcctttctgtcctctccccggtcccagtgcaccccttaaacaacgacccccgcgttttccccgtactagatggttagggcgcatagtgccgaactacgctgctgctacagaatagcttttttgggggcaacataaaaaagaattgtatgtatggtttatatacaacaaaatgtcccattttcagtgtgcaaatcgacgggatttgacaaattatacactcctgtaaccattatcccaaagtgaacattgaccatttccttcaccctgcaaagttccctggtacctcctttctgtcaatccaccccaggccccgcactcaaccccggttctgattgttatcatagcttagctttgactgttctagaacttcatagaacaagatcatcaggtaagtactcttttgtgtctaacattactttttaaatggccatcactgagaaggtgtctctgggtgcttccggtgcttttatttgctctaggcctgcctggtctaatgtgggagccactggtcacatgtggttattgaatactggaaatgtggcaaaatccgtactgagatgtgctctgagtacaggcacctgatttctgaaagcttagtacacaaaaaagatgtcaaatatctcactaatacattcttacattgtgcgttaaaagtgataacatttttggctacattgggttaaataacatatattaacatgaacttcatttgattctttttacttttttaatatggctactagaaacttaaaattacgtacctggctgtgtaatattttttattaggtagtggagacagcacagctctacactgtgctatcctataaacacttggttctgctcactgcatgtaagagtaaatgaaaaacttgtcttgacaccagaaacaatcctcaatggaggaagtgatctaaaacagggccagcctttccctgaacctttgaaactttgttaaacttacttgtgtgcttaaaagaagtagagggccgggcatggtggctcatgcctgtaatcccagcactttgggaggccgaggtgggcggatcacgaggtcaagagatcaagaccatcctggacaacatggtgaaaccctgtctctactaaagatacaaaaattagctgggaatggtggcatgcacctgtagtcccagctacttgggaggctgaggcaggagaattgcttgaacccgggaggcggaggttgcagtgagcccagatcgtgtcattgcactccagcctggtgacagagcgcgactccaactcaaaacaacaacaacaacaacaaagtaggaagaattaggtgtccccttggtattaagttgcatttttacaaaaggtctctaaaatatccaaggtgctttaaaaaggtatcttgtgtttttgaaaaaacagaaaatgagcaattgcttatgtaggggaggaaagagctgatatcataagggtcacggctgacagccttaaacaagagacagattaacaagagagaagcataataatttattgaatcataggtttatgtgacatgggagccttcagaaatgaaaaccccttaaagatgcaagggaaatgatctgattttatgcttggagtccatgaagcagggacagatgagctaatggaaatagactgagtggggaaacccagcaaagcctgtccacattcttcttggcctctctgttgtagcgtttcttcctccccagtatggggtaggacctctttggaatgagggtcttaatttctttatggccagctgttgtatagaaaggtggttgagaggaaggttagagtcatattttttggctttatggctggctttggggggaaaagggttctagtttctatgacttgccttgggggagtatgaggggtgagagacaggagggcaggagaaggtcagagagaaactttgcttctgaggccttcatttttgggttttgttttctgagccccaacacatacaacctaatcacctaaatatattaagacataacatggtgtatctttgaccaaattaagatagaaatctgtttttttttttttttttttttttttggagacagagtctcactctgtcaccagggtagagtgcaatggcacgatcttggctcattgcaaccttcacctcctgggttcaagtgattctcctgcctcagcctcccgagtacctgagactacaggtgggtgccaccacgcctggctaatttttgtatttttagtagagacaaggtttaaccatgttggccaggatggtcttgatttcttgaccttgtgatccgcccgccttggcctcccaaagtgttgggattacaggcgtgagccattgcacccggccataagatggaaatcttagtggtgacaaataaaatttagatcttagtttaaaaaaacatagtcaataatatattcaattttatagtctgctctctttttcaggtaacataagcattttctttcttcctttttttttttttttgagacacggttttactttgttgcccaggttggagggcactggcacaatcttggctcactgcaacctccacctcccaggttcaagcaattctcgtgcctcagcctcctgagtagccgggattacaggtgcacgccaccacacctggctgattttttgtattttagtagagatggggtttccccatgttgcccaggctggtctcgaactcctgagctcaggcaatccgcccgtcttggcctcccaaagtgctgggattacaggcgtgagccaccgtgcccggccacataagcattttctttttttttaacttttttttttgagacgaagtctcgctcttgtcccccaggctggagtgcaatggtgctatctgggttcactacaacctctgcctcccgggttcaagcgattctcctgcctcagcctcccaagtagctgggattacaggcgcctgccaccacgcctggctaatttttgtatttttagtagagacagggtttcaccatgttggccaggctggtctcgaactcctgacctcaggtgatccgcctgcctcagcctcccaaagaagcattttcttatacaaaaatttattaggcataatgtgacttgtacgaatgtatgccagttttcttcaccatacctctacggcatttttccatttcggtaacttttacaaagagagtcatttgaacagtataacagtgccagaataaggtataattaaagcacagtttatttgccccttaatcctgcaggaaaggtgaagtccagtggaacatagaccttgtctttttgtttatctccatattcctaggacttggaaatatgtcaagcatgtaatagatgttcaaataaacattatatatgtaatatatgtatatatataatttatttatttatttatttcagacggagtctcactctgttgtccagactggagtgcaatggtgtgatcttggctctgggtttggattgacaatgttttaagctataaacataggtcagataggtgggtgccctggtgactagtgaagatgtgcgatggcattgaatgtgatcaactgtgttgtgtagagaaaggtaggcccagggacttagggaggccatctgggatggaacatgtatattttgaatagcttcagtttactcagcctgaccatggtcagctagttcaaatggaattcacagctctgacgtgtgataactttagttaagatagtttgttttgaaaggtaagcagaggaaaccacaaaatcagaatgggcattcctttgaggaggacaaataagaagtgggtaactgaaattgttcctacccgaatgcatttgtgctgaatttccaagtatgtaaaaaaattgtgaaattacaaatgaaagtgaaatttatagttattaccttttgttagttactgtctctctctctctctctttttattttttcttttttggtaccgagtctcaccctattgtccaggctggaatgcagtggtgtgatctcagctcactgcaacctccgcctcccggcttcaagtgattctcctgcctcagcctcccatgcagctcatgtagctgggaccacaggcacacgccaccacgcccggctactttttatatttttagtagagacattgtttcgccacgctgaccaggatggtcttgaactcctgacctcaggtgatccgcccgccttggcctcccaaagtgctgagattacaggcatgagccaccgcacctggtctctctttttatttttgagacaggatcttgctttgtcacccaggctggagtgcagtggcacaatcacttggctaactgcagccttgacctcctgggctcaagcaatcctcctgcctcagcctccccagtagctgggactacaggtgtgtgccaccacacctggctaatgttttatttttcttttgtagagagggagtctcactatgttgaccaggttggtgtcgaacttctgacctcaagagatcctcccacctcagccttccaaagtgttgggattacagatgtgagccaccatgcctggcattatttttctttttctgtaactgtaattttatattgtggtcttactcagttgcccatttgcctgccatgagtacacaaataatactgtttatggtctactttcacatacatggtgaaattacaagagcagaaggcccctgtacacactcaagggaaaaacaatagtactcaaagtaaagaaaatcaagttattgggcttcctataaaacaaaagggtttgaatcagaaagcagcagaaaagtcaaataaattttccttatgactgtcaacttaaaaatcacaagatctataaatttagaaaggagactttcttttttaaaacattttcttttctttttttttttttgagacagagtctcactctgttgcccaggctggagtgcagtggcgtgatctcagctcactgcaacctccgcctcccaggttcaagtgattctcctgcctcagcctcccgagtagctgggattacaggcgcatactaccatgctcggctaatttttgtttgtttgtttgtttgttttttttttgagacagagtttcgctcttgtcacccagactggagtgcaatggtgcgatctcagctcactgcaacctcctccacccaggttcaagcaattatcctgcctgagcctcctgagtacctgggattacaagtgcccacaaccacgcccggctaatttttgtatttttagtagagatgggatttcaccatgttcgccaggctggtcttaaactgctgacctcaggtgatccacccgccttggcctcccaaagtgctgggattacaggtgtgagccactatgcccagcctaacttttgtattttttagtagagacagggtttcatcatgttggccaggctggtctcaaactcctgacctcaggtgttccgcctgcctcagccttccaaagtgctgggattacaggcatgagccattgcacctggccaaaatttttcttacctttcgagtcggagtctcactctgttgcccagaccggagtgcagtggcacgatctgggctcactgcaacctctgcctcccaggttcaagtgattctcgtgcttcagccccgcaagtagctgggattacaggtgcctgccaccacacctggctaattttttatttttagtagagacagggtttcaccatgttggccaggctggtctcgaactcctgatcttaagtgatctgcctgcattggctgcccaaagtgctgggattataggcgtgagccactgtgcctggtgactttatttcttttcttttctttctttctttttttttttttgaggcagagtcttgctctgtcacccaggctggagtgcagtggcacaatctcggctcactgcaacttccgcctcctgggttcaagccattctcctgcctcagcctccctagtagccaggattacaggtgtgcaccaccacacccagctaatttttgtatttttagtagagacagggtttcaccatgttggtgaggctggtctctaactcctgacctcgtgatccacctgcctcggcctcccaaagtgctgggattacaggggtgagccaccacgcctggtttactttatttctttgcaggctgtaacagcctgcaaaggggccatcccacaggctgggaagcacacgttttaaagagacagggtctcgctatgttgcccaggctgttctcaaacttctggcctcaagtgaccctcctaccttggcctcccaaaaccagaggcaggcactctgaaggagggttcagttttatgctgaatgggttggctaaatatacatattcaacaggttacaggaggagctatgaatattcatgaaggtggtcctgactcatgtgtattgaataaacatgaaaatagcatatgacccctgttcactttggggatggagacttaacatttaaatgaatttcagttaagccctatgcatcaaaagatctttccaggacatgaaggcacgcaagtccacagcctctgtaaactggccagagccagtccatggttggtggtcttatcaggagaaagttactcaaatcagtctcttgtccaataaaagctgtagttttgactggtgtaacaggactcagtcagtcagcatctgtgagctagatgagttgtaattattttaatattgcttatttaaaaacagtttttattttttatttttttgagacagagtctcgctctgttgcccaggctggagtgcagtgagccactgcacctggcaagacttttttttttagagtaattttaggctcacagcaaaactcagtggaaagtacagagttcccatacaccctctcccccactgctatgcccagcctccctgactattaacatcctgcacctgcagagtggtacatttgttataatcagtgaacctacattgacgcatcatttttgcctaaagatcataggtttttgttttgtttttttgagacggagtttcgctctcattgcccaggctggagtgcaatggcctgatctcggctcactgcaacctctgcctcccaggttcaagcgattctctcttcctcagccttcggagtagctgagattacaggcatgcaccaccacacctggctaattttgtatttttagtagagacggggtttctccatgttggtcaggctggtcttgacctcccgacctcaggtgatctgcccgcctcagcctcccaaagtgctgggattacaggtgtgagccaccgtgcccggcggaaagtctgtagtttatttacatcagggttcgctcttcctgttgtccattctgtgggtttggataaatgtgtaatgacatgtatccatcattacagtattatacagaatagtttcactgccctaaaattcctttgtattgtgactattcatccctctctccctcctacccgctgacaaccactgatctttttactatctctctagttttgctttttctaaaatgtcatatagttgaagtcatacagtatgtatgtttttcagattggcttctttcacttggtaatatgcacttgagattcctccatgttttttcatggcttggtagcccatttttttttaacaccaaattatattcctagagattgttgtatattttccactttacagatgaaggaataggcacagaaaggataaataacttgcccaaggccgggcgtggtagctcacgcctgtgatcccagcacttggggaggccgaggtgggtggtcacttgagaccaggagttcgagaccagcctggccaacatggtgaaatcccatctctactaaaaatacaaaacttagcccagcatggtggtgcatgcccgtaatcccagctacttgggaggctgaggcatgagaatcatttggaccggggaggtggaggttgcaatgagccgagattgtgtcactatactccagcctgggcaacagagtgagaccctgtctaaaaaaaaagaaaaaaaaaaaaaaaagaacttgcccaggtacagtttgtacagatcagtctgacactggagtctgagctcttaaacattttagcatgcctgtgaatcctagagaaatttggtttatcatgatgaagtttgttgcatgatagagttgaggtctttggaaacccagggcaacagacctaggcactttgcttgcagaaggtatctacagctttctgtatagtgacaacaataaaaagcctagaagataagactttgtttcaaaaaattcaagtatttagtttggacagaaaactgctgtgtgcttttgaaattttggtgagacgaagcatggtggctcacttttgtaatcagcatcttgggaggccaaggcaagaggattgcttgagcccaggagtttgagaccagccagggcatcatagtaagaacctgtctttacaaaaatgttttaagaattagctgggagacgtggcacgtgcctgtagtcccagccactctggagcctgaggcaagaggattgcttgagcccagaagttcaaggttgcagtgagctatgaacatgccactgcactccagcctgggtgacatagggagacactgtctcttaaaaaaaaaaaaaaattctgagctaggtgcggtggctcatgcctgttatcccagcactttgggaggctgaggcaggtggattgcttgagctcaggagttggagaccagcgtgggcaacatggtgaaactccgtctctacaaaaaacccacaaaaattagcagggcgtggtggtgctcacctatagtcccagttactaggatgctgaggtgggaggatcgcttgaacccagcgagcagaggttacagtgagccatgattgcaccactcactgcattccagcctgggtgacagtaagactatgtctaaaaaaaaaaaaaaaaaaaattaattctggttgaatacactgtctgctttactagttttaaatatttctctttccttatccataattttattgcctttcagattatatctgggtgttggcacccagccactattctgccaatgaagtacatcctggtcacgggtggggtcatctcaggcattggtaaagggatcattgccagcagcattggaacgattctaaaatcatgtggactccgagttactgccataaaaatcgacccctatattaacatcgatgctggcactttttcaccttatgaacacggtacgaaagtgaaccacttcccccttatagcactaggctcaactgcattctttcttccattttgggtaatttctttaggatgtagttccagatttagagtgactagatcgtatgctatgaatatgtgaattttctcatggtcattgatacattgttcatacctctgatgacattccaaattaatcatcccttttggaaacattgtatcttttgcactacagattctgttttatttttaacataaaggtagtgtgtttctcttaacatttcccactgcctggagtaactattattaatggtgacattttgatgtatgagtatatttgatttatttttaaaatggcattagcccttacatgctatttttaaaaaactttttataaggcccagtgcggtggctcatgcctgtaatcccagcactttgggaggccgaggcaggtggatcacgaggtcagaagatcgagaccatcctggctaacacagtgaaaccctgtctctactaaaaatacaaaacattagctgggcgtggtggcacgtgtctgtagtcccatctactcaggaggctgagacaggagaatcacttgaacctggcaggcggaggttgcagtgagccaagatcgagccattgcactccagcctgggcgacagagcgagactctgtctcaaaacaaacaaacaaacaaacaaacaaaaacaacaaaaaaccaacccccaaaaaaacctttttatatacaagcaaaaaagtgcataaatcataagtgtacagttggatgaattttcattaaatgaacacactgtgtaaccagcccctgatcaagaaacagaaatgttcatgtcctgccgggcgtggtggctcacgcctgtaatcctagcactttgggaggctgaggcgggcggatcacgaggtcaggagatcgagaccgtcctggctaacacggtgaaaccccgtctctactaaaaatacaaaaattagccgggcgcggtggcgagcgcctgtagtcccagctactcgggaggctaaggtgggagaatggcgtgaacccaggaggcgaacttgcagtgagccgagattgcgccactgcactccagcctgggtgacagagtgagactccatctcaaaaaaaaaaaaaatgtttgtgtcccttgttgctatcctgtcttcctgtttttgttttttgagacagggtctcactctatcgcccaggctggagtgcagtggccaagatctcggctcaatgcaacctccacctcctgtgctcaagtgatcctcctgcttcagtcccctgggtagctgggattacaggtgtgcaccaccacacctggctaatttatgtaatttttttatagagctgggatttcgccatgttacttaggctggtctcgacctcctgggctcaagcaatcctcctacctcggcctcccaaagtggtggtattacaggcatgagccactgcaacaggcatgagccactgcaccaggccttgaatatcgtgttttaaactttactaacctgagaataaaacaaacaaaaagagggtatcttattgttttaatttagagttctttgattttgattttgtttgtgaatgacttattcaagtctgtggtagattgtatttttgcttcaaaatgttacccaccatccctctgtggagtacatttccctgccctttgaccttggagtttggccacgtaggatagttaacttgtcctggtttgtttggaatgttcctgattttaaaacagaaagtcctgtgtcctgggagccctcttagtcctgggcaaaccaagcaggttggtcactctatttggccatgtgatttattttgtcctatgggatgttagggaatattaacatatgccttgttgaagcagaaaatgtcaaatgcatctgtgtggtttggctcagtctgtcttgtgcttctgccctctaccatgagaacagcctggttttcagagatttctcgttcagtctgggtcctggaatgagaagacacaaagaatagactcacaagtgactcatagcccccatgtaacatgagggagaaataaataaatgttttgtaagttgcagagattttggggttgtttgttgtgtggcaccattgactaatgccatgtgttacaccaaattttctttggatttttttttaatgattttttttttctttttttgagacagagtctcactctgtcgcccaggctggagtgcagtggtgtgacctcggctcactgcaacctccgcctcccaggttcaagcgattctcctacccagcctggcaaacatggcgaaactctgtctctatttaaaaaaataataggccgggcacggtggctcacgcctgtaatcgcagcattttgggaggctgaagcaggtggatcacgaggtcaggagatggagaccatcctggccaacatggtaaaaacctgtctgtactaaaaatacaaaaaaattagctgggtgtggtggtgcacacctgtaatcccagctactcaggaggctgaggcaggagaattgcttgaaccagggagtcagaggttgcagtgagccgagatcgcaccactgcactccagcctggcgatagagtgagaccctgtctcaaaataataataataataataatggtaatacaaagattagccaggcgtggtagtacatgtctgtaatcccagctacttgggaagctgagacatgagaattgcttggatccaggaggcggaggttgcagtgagctgagatcacgccactgcactccagcctggttgacagcgaaactctgtctcaaaaaaaaacattgaaaaaaaaaattgaaaaaaaaagtattgtgatatcaatttgcttttttccttaaaattaattttctagaccacagttatgtaccttagaatggataaataaattaggatataaaaggcttctgattaaatttgtaagttaatcaaccttttttcctgtggacatctaacagtaggaataaatgatagttcccttaataggggaaaggttcaattcttacaaggtggctttagaaacatacgactctcagtccatgccctgaagtgacaatagagatctacagacgtgtctagtagttaaagttggtgctcctcgtgtgacgaagtctgcacctgtcttttatgacagtgcattgtgcacgtagcttatggcacacacaggctttttccctcactttcaccaagttgccttatgggttagctgtggccttgctttgtcatctactgtctaattatggctttaatcaagatgagaatcaagtaaaagtttcttatcgcagttccagagtccaggatactgatgctttgaagtaaaatgctgtttgtttttaaaatttctgttttcatgtcttttttatgtggcatatgttgagtttggaaaagctaaatcttgaagacagaatttcagtagattaaaaaaaaaccacaatagaatattataaatagaattttctgatgcattttcttggatataattgaattgttaatatctccaccaaaaaggagatggtgatagaatatggcttacaaatacatcttttaccagctttttaacaaaaatatgtccatctttgaaaaatctactggaagcaaagttttgatttttccattgcctttttaatcctaggtgaagtcttcgtcttaaatgatggtggagaagttgatttagaccttggaaattatgaaagatttttggatattaatctttataaagacaacaatatcaccacggggaagatatatcagcatgtgatcaataaagagaggcgtggtgattacctggggaaaacagtgcaaggtattatattccacagacattatggagccctgtgtgctgaatatctttgtactgctcaaaagtagaactgaaggccgggcacggtggctcaggcctgtaatcccagcactttgggaggctgaggccagtggatcacctgaggtcaggagttcgagaccagcctgaccaacatggtgaaaccccatctctactaaaaatacaaaaattagccaggcatggtggcgcatgcctgtaatcccagctattcgggaggctgaggcaggagaattgctcgaacccaggaggcagagattgcagtgagccgagatcgtgccactgcactccagcctgggcgacagagtgagactccatcttaaaaaaaaaaaacaaaacaaagccaaaaaaaccaagtagaactgaaaatgtcacagtccctgcgctctacaagttctaattcttttaaaattgttgcgtttttttcttttcattttccaaaaatatgtcagggtaacttgccaggtgactttcaggtgattggggaggcctaaagcacattcttttctcatgagcatggaataaacttttgtattaatacttctttctacagttgtccctcacattactgatgctgtccaggagtgggttatgaatcaagccaaggtgccggtggatggtaataaggaagagccccaaatatgcgttattgaggcaagcatagaactttctttataaaattatatcctgctgggtctttgagcatctgatcttcatttatttgacaaatacttacacacgccctcctgagtgctggacactgggctaggaggtggggtcacagcaagaaacaacatagatggcttctgtctttgtggtcacaagtgagtgggcaagattggcattagacagacaatcacacctactcctgggtggacgtgcagtgatctgcttgtggagactgatcagctgctgataaagtcaatgtgagggcctcttctgtgccggggcctgggatgggcacagtctctgaccttggggagcttgcagacaaccctgtctacacacaacagactgcattctagtgcatactatttgaaaagtatttccgaagtgctttggaagtgtaaagagacactgggttagggaagtcagatggtagcggtgataagtgattagtatcagctgtttaaagaaagaagctagtggctgcgcgaggtggctcatgcctgcaattccggcattttcagatgccagggtgggaggattgcttgagtccatgagtttgagacagcctgggcaacatggcgaaaacccgtctctacagagactacaaagattagctaggcatgttggtacgcacctgtagtcccagctacttgagaaggtgagatgggaggatcttttgagcccgggaggttgaggctgcagagagcagtgattgcaccagcacttcagcctgggtgatggagccagaccctgtcttaatttaaaaaaaaaaaaaaaaaaaaaaaaaagtcgtatttgaacttgccacttgtttacttccttcaccttgttcccttcctctccacgtgcagaatgacaataacatccatatcctcctcctctaaatgtcagttggcttaattgccgggcgaaagagcagaataatgaccaatttggttcttagagtcaggctgcctcagtttgtatttctgcagtgacccctgagccacgtatagctcagtgattaagagtctggaggcaaactgtctgggtttgtagcctagcaaggtcacttatggggaggagggggtgaccttgggcaagtttgctcaacctctctgtgcctctttaactcatttaactcatttgtaactcattgttttgaagattaaataagtctctacacttagtgcttagaatggtgtcacagatatagtaagtgcttaaaaattattagctattattaagatgcctgtatgacttttggaaaattctcacagtttcaacgtcctcatttgtaataatgtaataatataatattataataataagataataacaggattggggattaaatgcaatgtatcagagcactttgcaatgtctggcatttaggaagtgctcagtgaacataagttagctattattattgtcatcaatgtaagtgttagcagatatcatgatatgtagaagatccattttgttaatagtagaactgataaagttactggctatttattttttatagatagggtctcgctatgttgcctcgggctggagtgcagtagctatccacaggtgcgatcaaagcccactgcagcctcaaacttctgggctcaaccaatcatcttgcctcagcctcccaagtagctgggactacagtgtaccaccactatgcctggcaaatttttaattttatttcttattctacccttgaattgacttgtcttcacaatgattaatttagcacttaatatgtactagccctgatgatagctgctaaggatgtgaggttgagtgtgatctgactcctgctctccaggagctcattggctggattttaaatttcatggaaacagggaaactgacaaacagaaccccttctccgttataaccctgatgtttatatttgcttattggatactagtggtcaaccatcctctttggttgattgtaagttgtgttcaacagttgtgtctgtgcaccatttaagcttttgaagaaggactgccaaagctgatttttagttttaatcatagaggagctgttgaaatgtcttcaaagccatttttatgagtgagacctcaacttctcataccagtggagctgacaggttttatttatattagtacgagttatcttggcatgaacctgaaataatttatgcttgtcttaaaggaataacagttttctttcttcttgtttattttccaaaaaagaagactcagccaagtgtggtggtgcaggtctgtagtcccagctacttgggaggctgaggcaggaggatcatttatacccaggagtttgaggccgcagtgagccatgatctcactactgcactccagcctgggtggcagagcgagactctgtctttaaaaaaaatttaaaaagggccgggtgtggtggctcacgcctgtaatcccagcactttgggaggctgaggcgggtggatcacgaggtcaggagatcgaggccatcctgtctaacacggtgaaaccccgtctctactaaaaatacaaaaaattagccgggcgtggtggtgggcgcctatagtcccagctactcaggaggctgaggcaggagaatggcgtgcacccaggaggcggagcttgcagtgagccgacatcgcgccattgcactccagcctgggcaacagagcgagactccatctcaaaaataaataaataaataaataaaaataaaaaaagaaaaagaaaaaagactttcattaaagacaaaggcaaaaacaactttgcacatctcataaatttgctgctgcttccatttcagcataaagtattgttataggtgatattttcccttttatctggggcaacagttaacttcaaactattccagtagtaatattgaaggtttctgaacacgataatgtgggtgacctagaggtatggtaatgggaacttctgaattagcagggagactgtagtaccgctgctgaccacgtgagggcagaagctgataatgtttgaagttggcctccttttggcattcactattattgaccccccagagaatccccatcaaaacacaagatggaagcacacggtttagtttaagtgcagacctctggttttccttagaaaaaataaatgattttcaaaaattagattttggtgccttgtatttagtgggtacttacactcacttcacccctgccaagttcctgattgcatgtgatgttttcatttcgttgagttgttgttgttgttgttgttgttttttaaagagacagtgtcttactctgttccctaggctggagtgcagtggtatgatcatgactcactgcagcctggacttctccaggctcaagcgatcctcccacctcagcctcctgagtggctgggaccataggcgccgtgccgccatgcccagctaattttttatgtttttgtggaggcaaggtctcactttgttgcccatgctggtctcaaactcctgtgctcaagtgatacacctgcctcccaaagtgttgggattacaggtgtgagccactgcacccagccctggctttggttctgctgtaattttggtaacaggtactagaacactgttccttagggcttatattgaatttcaggacctttctgtcctggcccgactactaaactaaacctccagtgctgcatgcagggtactgggctcatgccctcatggggcttacagtctagtggggtagagagccaggaaacaaagacggaaatgaaatagaggcaacttgtgctgaattcctaggatgggtacagtgctgtgacaagggctagtgggatataggctgctttaggtggggggtcagagtctgccctccaaggagggtcagagtccgccctccaaggaggatgcatctctcttggactggaggataaagaggttgctgtagatgaagaaggagggtaggagggcttaaggagcaggaaggaagagcatggagtacccaagaggccagcggggaggggaccagatggcattggagactcagtgcaagggccaggtcctgagagccttttgttggctgcattaaggagatttgatgctagttttttgtttttgtttttgttttgagatggagtctcgctctgtcgcccaggctggagtgcaacggtgtgatctcgactcactgcaacctctgcctcctgggttcaagcgattctcctgcctcagcctcccgagtagctgggactacaggtgtgccccaccacgtccagctaatttttgtatttttagtagagacagggtttcaccatgttggccaggatggtcccgatctcctgacctgtgatccgcccgcctcggcctcccaaagtgctgggattacaagcatgagccactgcgcctggccttattgttagttttaatgaagcaatgggctactgaagagtatacacgtggagaaatcttttttgaagttttattttttatttttatattttttcagagaaagggtctcgctctgtcatctaggctggaatgcagtgggatgatcatgactcactgcagccttgacctcctgggctcaagtgatcctcctgccttggcctcccaaagcgctgggatcataggtgtgagccgccatacccagccacaatttagtgattttgaacgtatttataaacctctgtgtaaccatcaaactttagttctcatgctcggtttattaagaactctttttattagcttgtgtactgtgggagatgtgtggtcatttgtgtctttttttgtttgttttccattcccagctgggaggcaccattggagacatcgaaggaatgccgtttgtggaggcgtttagacaattccagtttaaggcgaaaagagagaatttctgtaatatccacgttagccttgtcccacaggtgggctttccagataagtatgtggacagcaactttgataagttttcctatgatattctatgtgtcctgcatttgaaagtggggcaccattaatcatccataggagctagtgtccagtgtgctgacgggaccccattttttttcagctcagtgctaccggagaacaaaaaaccaaacccacccaaaacagcgtccgcgcactgaggggtttaggcctgtctccagatctggtgagttgaggacagtgggtaagtctatcctgaaggtctctgggagcaggaccttcacttcttttttttttttttttttaatttgagacggagtcttgctctgtcacccaggctggagtgcagtggtgcagtcttggctcattgcaacctccgcctcctgggttcaagcgattctcctgtctcagcctccagagtatctggactacaggcacatgccaccacacctggataattttggtatttttagtagagacagagttttgtcatgttggctaggctggtcttgaattcctgacctcaggtgatccgcccgcctcagcctcccaaagtgcttgggattacagccaagagccaccatgcctggctgcccttcacttctttatctttatcatcatctaagtcctttctcattctcaaacggctcctgtgacaatgaggtttttctatctgggagccggaaaaggcttattcccttagcctcaagtgttgcttcaatctgttcttccctaggctctcatttgatgggccacattgatagttgggcaagtgtgatgtcctgtcatttatatgattcctggattctttagaatgaaggtgaaaccttgggattttcctgtgaccctgctatcaatgataaccctgtgatgggttatcactgctctttttttctttttgagacggggtctggctctgttgcccaggctggagtacagtggtgtgatcttggctcactgcaacctctgcctcctgggctgaagtgattctcccacctcagcctcttgagtagctgatactagaggtgcacgctaccacagcgcactaatttttgtgtggtgtgtgtgtgtgtgtgtgtgtgtgtttgtagagacagggttttgctatgttactgaggctggtctcgaactcctgggttcaaccaatcctcctgccttggcctcctaaagtgctgggattgcaccacgcccagtccgctgctcttatttttagtctaaacagtgatgtgtccttatagcaggtgatccagtcatcaccagtagtctctgtcagaggttgacaaataacagcccacaacttgcttgcctgtttttgtaagtaaagttttattggcatgcagtcacacccattcatttacatattgtctgtagctgctttcacactgcacctcaattgaggatcaggacagtgactgtgtcacctgcaaacctaaaatatttcccatctggcccttttgagaaaaagtttgttaaccccgatctagctcttttcttgtagttaatgaagcaacacttgtgagcctggactctgttcaccagagacgtctcgatgtttcgagttcttactgatacacttatgctgaatttgattatacttatattagtgctcagaccaatttctaatagtccagtggaatgtccaaagtgaacaagtacatacttggccaagtttcttgtaaaaagaaatgaatgtggcatcctgctgaaagtgaatcctgtttgctgaagcataactggctttgacagattgtctgccgaagttcaacgcccattgagatggccgtgaaggagaagatttctatgttttgtcacgtgaaccctgaacaggttggtgctgctctttagattttattgtctggcaggcacttctgctgatgccagtgttttgtacctcttcaatgatcatattacttttcacggcatttatgcaagcactggggaaccctgatccaaccatgattccctagcccttaagtgagataggatgcatgtttctttgcatgatcactcaacttatgtcacaaaaccagggtgggctttcttttcttgagacagagtgtcactctgtcacccaggctggagtgcagtggcatgatctcagctcaccgcaacctctgcctcctgggttcaagcaattctcttattttagcctcctgagcagctgagattataggcatgcgccaccacgcctggctaatttttttgtatttttagtagagatggggttttgccatgttggccaggctggtctcgaactcctgacctcagatgatccgcccgcctcagcctcccatagtgctgggattacaggcgtgagccatcgtgcccagtaccagggtgggtgtttaactcacagtcaaacctctagagagagaaccacatgaagcctacttatcatctctttatcttgtgtttccttctggaacacttactgctttcactcatttctcctctctacctgtggcagcttaagtcaccccaaacacacgagcacgttgacattcgcactagctcttctgactccatcagtgggctcagttgacttcattggtacagaaactgtactgtgatttgggcttaggttctctgctctgtagggctttccaccttggtattctgataattcgcttttcttttttctttccttctctcatctctgtctcttgattccaataaggcttggttataagggattggagttacctatagtttaaagagagtgatataaatggtgctcaggaaaagggtgaggtttggcagaaatcttttcttcagattataactctgggttctctgaagtctaaaaatgatcaaattgaattttggcatcttggaaaatagtctgatggagagccccctgcctgatgcctcagagtcattgccgaagtctgaactactttgaaaaatgtgatggcagattgaagggacacttctgcatctgtatgttgatatgttgtcatgccattttgtttgcgtccaatctttttttttttttgagacagagtttcactattgtcacccaggctggaatgcagtggtgcactcttggctcagtgcaacctctgcctcctgggttcaagcgattctcctgcctcagcctcctgagtagctgggattataggtgtgtgtcaccatgcctggctaatttttgtatttttagtagagatggggtttcaccatgttggccaggctggtcttgaactcctgacctcagatgatccgcctgcctcagcctccaaaagtgctggaattacaggcgtgagccaccacacctgacctgtccaatcgttttgtgtacacttcttttttttttttgagatacagtcttgctctgtcacccaggctggtatgcaatggtgcgatctcgactcactgcaacctccgcctcctgggttccagcgattctcctgcgtcagcctcttgagttgctgggattataggcacatgtcaccatgcccagctaatttttgcatttttaatacaggtggggtttcaccatgttggtcaggctggtctcgaactcctgacatcaggtgatctgcccgcctcggcctcccatagtgctgggattagttttctaattaaatgaagctaaccttgtgcaaattctgatgctagctttggttgctgggtttttgtgtgtgcgtgtgtgtgtgttatatcagtgtaaataaactgccagtctctgctgaattttgtttcattcttgtggtggcatatttgaatagatccatctaagtatggtgatttctcatcgccacttaggtcatatgtatccatgatgtttcttccacataccgagttcctgtgcttttagaggaacaaagcattgtgaaatattttaaggagagattgcacctgcccatcggtgattctgcaagtaatttgctttttaagtggagaaatatggctgacaggtaagcgaaaggaattacttgtataatctttaataatttttgagtttgggggtagaactaagacctacttgaaagggtaagcgtgtgtatttggcattttgcgtgtgcacattttggtctggatatgtctaaagatggagcatactgttgcggtgctttgctgtattatttgaagatttctggagcctttgattttgttatacataaaccaaagtgaattaaaggaattcgaattctggaaggaatgtttttttagctctggaaggattctgatttatttgatttatttgctagttcattttttagtttctgaatatttaaaatttttttttgtttgttttcttttttcttttttgagagtcttgctctgtcacccaggcgggagtgcagtggcacgatctcggctcactgcaacctccacctcctgggctcaagtcatcctcccacttcagcctcctgagtagctgagactagaggcacacaccaccacacccggctaatatatatttttttttttttgtagagacgggatttttctatgttacccacactggtcttgaactcctgggctcaagtgatctgcccaccttggcctcccaaagtgctgggattataggcatgagccaccatgcctggccttaaacagttttaaacttcacaggttttttgttttgttttgttttgcttgtttttaagatttggctaacttttcctaaagaaaatcattttggatgggaacttttggctatgctagttttgtttcatcctgcattcattaactgttcagcataattattaaaactcctgatggattctaactttcagacaagtatattaatttaagcaaagtttctctattttgaagttatatgaaaattaagctgtgtgcagtggcacttacctgtagtctcagctacttggaaggctgaggtgagaggatcacttgagcccaggagttggaggccagcctgagcaacatagcgagaccctgtatcttaaaaaaaaaaaaaaagggaaattaagtccctgtcacttgttttctttttttttgagatggagtgtcactgtgtcgcccaggctggagtgcagtggtgcgatcttggctcactacaacctctgcctcctgggttcacgccattctcctgcctcagcctcctgagtagctgggattacaggcgcccgccaccatgcccagctaattttttgtgtttttagtagagacgggggtttcaccatgtttgccaggctggtctcgaacttctgacctcaggcgattcgcctgtctaggcctcccaaagtgctggggttacaggtgtgagccaccgcgcccggccctgttttcttttactaaatgtagttgagatgggacttcttgggcagcttaggtgagcgccagtaggtgcagctgttacgtatgtaggttctggactcaaatcctggcctcttctcttaccagctgtgtgagtttgggtgattacttaacctatctaggctttttttcccttctgtatataataaggggataccagtgcctacctagtggcaattatgagaggaaaccttaaagacttaacattgagtcacgtactataataagtatcggttgctgatgttggtaaccataattaaaatgatggtgacaaaattactgacccttggtagatgactaatcagattgaggctctcttgctctttcatttacaattttaaaaaatgctttagattttctggggcaagtggaatcaggaaggaagagcagtttctgagcttagattctctaaaacccttgctctctagagtgcttaaagtgccagtcatttcacaggaattttctaagtagcttggggctgatacactttaagcactagaagttttaatattttaactctttttattggaaatagctctaaattatactctatgcgtttatgctttttttctttttcttttctttcttttttttttttttttttttgacacagggtgttgctctgttgcccaggctggagtgcagtggtgcaatctcagctcactgcagcctcgacctcctgggctcaagcgatcctcctgcctcagcgtccccagtagctgggaccacaggtgcgctacaccacggccaactaatttttgtatttttagtagagacggggttttgccatcttgctcaagtgatcttcctgcctcggcctcccaaagtgttgggattacaggaatgagccatatgcctggcgcttctgtgctttttaaagccacatgtttggtctttgtattagcttcctgggggctgccataacaatgaccactaactgggcagcttaaaaaaacacaacaggaatttattctctcacagtcctggaggtcagaagtgcaaaatcaatgcatccacagggttggttccttctagaggctctgcaggagattctctgccacaccccttctcctggcttctggtggctgccagcaatcagtggtgttccttggcttgtggccacatcactccaatcttgtcctccatcttttatttccttatttatttttttttttttgagatggagtctcactctgtcacccaggctggagtgcagtggtgcaaccagggcttaatgcaaccttgaacttctgggctcaagtgatcctcctgcctcagcctcccaggtagctgggactacaggtgcatgccaccatgcttggctaatttttgtgttttttatagagacagggtttcaccatgttgcccagcctggtctcaaactcctgagctcaagcaatccacctggtttagcctcctaacgtgttgggattaaaggcgtgagccaccatgcccagcctttggcctccaggcctccatcttcacatcaccttctcacttgtgtcttcttcccttctcttcttttgtaaggatgcttgtcattggatgtaaggcaggccctaatccaggatgatctcagctggagagccttacttatgtctgcaaagaccctttttccaaacaaggtcacattcacaggttttggggacaaatttctttgggggggggccaccattcaactcactacagcctttttatttttaatttttatgggtacatagtaggtgtatatatttgtagggtacatgagatatttggtacaggcatataatgcattataatcacatcagggtaaatggagtatccatcacctcaagcctttatcctttctttgcaatacaaacaatccaagtatactcttttatttatttaagaatgcacaataaattgttgacaattttcaagcaaggagatattgtgcatgggtgcctctgcagcactgggcctccctctgcatcacattggtggtgacattgttaattgatgcgaagtgtccattctttagctttggtcctctcagtatagcctgtagagaggtgcaaggagccaaacggaggccaaaggaacagcctctatcatggaggcccagtgctgctcagaggccaggggtccctgattaaacagggacagcttgcctgggacccgaagtcaaggtgggcacaattctccacctcctcctattcattgtcttttttttttttttttttttttttggagacagagtctcgctgtgtcgcccaggctggagtgcagtggtgcgatctcagctcactgcaagctctgcctcctgggttcatgccattctcctgcctcagcctcccgagtagctgggactacaggcgcccaccaccacgcccggctaatttttttttttttgtatttttttagtagagatggggtttcaccatgttagccaggacgatcttgatctcctgacatcgtaatccgcccacctcggcctcccaaactgctgggattacaggcatgagccaccacacccagccctcttcatctctcttgagacccgactcttgggggtggccctgcaaagaggactcccctccccctcccacagcagcttgaagtagtatcacatgcttgcctcacattcggtgatggctgatggctgagtggggcacatgagggagaccttggttgctctcggaagtacaggtccaagggggaatgagagctccctggtaggtgtgacccagtggactcacctgtaccacctgctgcccagtgactcctcccctgggaagaccagctgtgagtgagccgtaggagtaacctgtgatactgaccccagtgctgcttccttccgggggcagagctgatgttgtctcttctgtctatggaggagggagaagggggtgaagccaaatctgctgttctcaaatgcggctctgcctgcctgcctctgacatcatctctactacttggtgtgctgtcatcctgctttctgttacccgcatcctcttttttttttggagaagaagtctggctctgtcgcccaggctggagtgcagtggcatgatctcggttcactgcaacccctgcctcctggattcaagtgattctccttcctcagtctcctgagtagctggaactacaggcgtgcaccaccatgccagcctaatttttgtatttttagtagagacagggtttcaccgtgttggccaggctggtctggaactcctgatctcaagtgatctgccggccttggcctcccaaagtgttgggattacaggcatgagtcaccacgcccggcccgttacctgcatactttatggagaggtggtgtgagatacagacagctgtgaaacctccagagcaacataaaataaagtagtgagttcaagggttagcagcttgaactattttagtcaccttttagtgaccttttatcagctattttagtcatctttctagaaagttaccttccctgtcagttttgacttcttagcttcttgtgcattattcccacacatagcctgtttgtgatctagtttctcttgtactctttacagatatgtgttctttttgtttttgtttttttttttttttttttggagacagagtctcgctctgtggcctaggctggagtgcagtggtgcgatctcggctcactgcaacctctgcctcccgggttcaagtgattctcctgcctcagcctcctgagtagctgggattacaggtgcgtaccaccacgcccagctaatttttgtatttttagtagagacgaggtttcaccatgttggccaggatggtctcgaactcctgacctcaggtgatccacctgccttggcctctcagagtgctgggattacaggtgtgggccaccgtgcccggccactctttgcagatgttgatattcaagagagatattcgtcatcatggtaacatttttctaaggtgtttggggaagggtttgcttcaaagccctaaaacaccttcagccccaagatgacatttccacgtacctaataccaaaccagatatttttcatgttctttgaacagatttcctgacaaaagcaacactaaaaattgtgtctctaatggtaaaatgtgatcgagtgtcttctgtagaatggaatttttctcataaaaatgatctaaatggctagtaatattttaaatcgttctctcagcaccattcttcaggcatgccatgaataaccagacttttgtgggtcagctgggaatgtaaccattttaaatgtagacactttgaatgcattttcttacacaatgtcaccttacaaagttaatattggaatgtttcctactgacacgcagaatgcattttttttatacaatgtcaccttattaaccaatgtaagaatagctcatgtttatgagattgggatagcttttcaatttttacttttaatgcttttaactttttctctgatatacttgaatttttatctgtatctgcttgtgtaaaacaacgttgggatttctgtttttgttttatgagacagtgtctcactgtgtcgcccaggctggagtgcagtggtgtgatcatagctcactgcagccttggtctcctgggctcaagtgatcctccaacctcagcctcctgagtagctgggattgtaggcatgccccaccacgcctggctaatttttgtatttttttgtagagacggggtctaactatgttgcccagtctggtctcaaactcctgggcttcagtgattctctcgcctcagcctcctgagtagctaggactacagctgctcccgaggatttaaaaagtgccttggagtaagagcagcagctgccattgttctgtttgtgatgttctgttatgtgcatataacctttgagtttgttttctttcccaggtatgaaaggttacagaaaatatgctccatagccctggttggcaaatacaccaagctcagagactgctacgcctctgtgttcaaagccctggaacactcagccctggccatcaaccacaagttgaatctgatggtgagtcctggcctggtcttttggctatctcagtaattcatgccaatagcacatgttccagaggggcaagttttgttaaagggtccctgagatcacctgcaggacttacgattcaccagaagaactcacaggactcatcatatagttatactcatagctaagatttattatagccagacaatgcaaagcaaaatcagccaaggaaaagtcgtgcagggtgaagtctaggagtaaccaggcgcaagcttctaagtgctctcccctggtagagtccagtgagttgtgataatacatgcaaactgccatttactaaggaagctcattgaagacttgaagcccaaggtttttactgggggctggtcacgtaggcaccctcttcttagcacttcccaaaatgccagcctcccagaaggaaagcatgcagcagaaaccatgttgtctgtacagacactttcagcacagtgagcttctcctatcagttcttggaatgatgggaaccctcccaaaatcagagtttccagaagccagtcaagtctcaatcttgtagcaggcctttccaagggcagcagccaggcttgctgtgtaaacggttttcttttttccttttttgagacacagtctccctctgccgcccaggttggtgtgcagtggcatgatctcggcccaccgcaacctctgtcttcaccgttccagcaattcttgtgcctcagcctcctgagtatctgggattacagactcccgccaccatgcccagctaatttttgtatttttaatagagacggggtttcaccacgttggccaggctggtctcgaactcctgatctcaggtgatctgcccgtcttggcctctcaaagtgctgggattactggcatgagccactgtgcctggcctgtgtaagctgttttctacatgtaggtttaaggcacatttctgaaagtaggctttgcacattcagatgaatgagcatgcttgtcatgctcgtttaagtacgtcgtaattgcctaacaggaaaataataggacattttttccctttagcattggaatggaatctagattttttaaaatactatattcccctctctaacatggaggaatgatagctagcaaacagtgattatttgttttggaaactcagtattgtggaataacagaggcgtagttatcttatatagcttgagtatattcttccatataagaacggaagtagtacatgtttagagtaaaacatttaaacaaagcataagccaggcgaagtagttcacgcctgtaatcccagccctttgggaggctgagccaggtgggttgcttgagctcaggagttgaagaccagcctgggcaacaatgggagacctcatctctataaaaaaaacttaaaaagttagccgggtgtggtggcatgcgcctgtagtctcagctaattgggaggctgaggcaggaagatcacttgagcccaggagtttgatactgcggtgagctataattgcgccactgcactccagcctgggtgacagattgagaccctgtctccaaaaaacaaaacaaaacaaaataaagcataaatctaaaatgcagaaagcagattcctcctccctgaaatcccacttgttaccagttggatacgtatatttatatatctatctcacatttatatttaatgatattcagtatgagtatatcattgtttaagcaagtcttatcatcttgacttaaatggcaaaaactttgtataatgagtaaaaagatccatttatatgttaaagaaatttaatggcttccactttgacactagcttaggagaactagctgctgtttctctctcctctttttagcctccttctttcctaatcactttttaaaaattttattttattattttttaattaattaattagttaattactttttagatggagttttgctcttgttgcccaggctggagtacagtggtgccatctcagctcactgcaacctctgccttctgggttcaagtgattctcctgccttagccacccgaatagctgggattacaggcatgtgccaccacgcccagctaatttttgtatttttagtagagatggagtttcttcatgttggccaggctggtctcgaactcctgacctcaggtgatccacctgccttggcctcccaaagtgttgggattacaagcgtgagccatcgtgcctggcctattttttaatttttatagagacggggtctcgctatgttgcccaggctggtctcgaactgctcaaacaattcctcctgccttggcctcctaaagtgctaggattacaggcgtgagccaccatgaccagcccctaatcactttttacttttggctttctaaggaatagtttacttcccattcctcccactccttcaagtcgcccgccccattatgtaaaaaaaagaaaatggcaatggaaaaattgccatgacatatacattttataaagcctttagaaatttgtatcttaaagtttatttgaatagtcttttttttttcttttcttttctttttcttttttttttttttgagacagggtctcgccctttctcctagggtggagtgcagtggtgcgatcttggctcactgcaacctccacctccggggttcaagcaattcttgtgccttagcctcctgagtagctgggattacaggtgcccgccaccacacctaattttgttatttttagtagagacagggttttgtcatgttggccaggctggtcttaaactcctggccttaagtgatccacctgcctcggcctcccaaagtgctgggattatagacgtgagccactgtgcttggccaggagagtcatttttacagaagaaatactaaactaatatagatagagagggactgttatatacataagaattggtgcacatgatgcttcatctgataggattcattgacattagcttctcctaagtactgtttgaatcctggccttgtcatcttccttctaagattgggctgcatctgtctatctctcctggtttgctgcagctgcagcggcttccgggctggtttccagctgccagtcttccctgcctttgccacactctaccagagtgatcattgtaaaatctttctcggttctctctgttcctgtcgtccctttacttaagatctttcagtggtgtctcagtctgttcaggctgctgtaacaaagtaccatagaccaggtggcttacaaacaactgccatttctctctcacagttctggaggctggaagtccaagattagggtgccagcatgtggccgggttctggtgagggccctcttttgggtgcagaggaccaacctctggttatatccccatgtgcggaaggggtgagggaggtctatggggccttttttataggggcactaatcctattcctatgtgctctgccttcttgacctaatcatccctcaaagaccccacctacctcctaataccattcctttgggagttgggatttcaacataggaattttgggggaacacagacattcaaaccattgcaattggcttcaagtgtcaagtctgtgtcatggcttctcagcctcgtcccttgccttcctccaaccaatcaggtctgtcctctcgctgggtggggccttttttgagggtcccagagtggctaccactttctctctttttcctctgaggtttcatataagtggttcctttgctggagatttcttttttttttatttatttttatttttttattttttgagacggactctcactctgttgaccagacttgagtgcagtggcacaatctaagctcactgcaacctctgcctcctgggttcatgtgattcttctgcctcagcctcccgagtagctgagattacaggcacctgccaccatgcctggctaatttttatatttttagtagagacggggttttgccacgttggccaggctggtcttgaattcctaaccttagatgatctgcccacctcggcctcccaaagtgctgggattacaggcatgagccaatgcgcccggcctgctggagatttcatacccttctcccctcctctctttgtctcctgctgcctcccatcacacacgtgcttatcttgcttctgctctcctctcggctggcttcttgaacattacctccccagagctcttccttgacgtcaatccttcctgtctttcctccagtgttcagttctagtgacgtcctagttgctttttttttaaatttttttttgagacagtgtctcactctgtcactcaggctggaatgcagtgttacaatcagggatcattgcagcccggacctcccaggctcaaaggatcctcccacctcagcttcccaagtagctggggctacaggcacgtgccaccccacgcggttgaccccaagttacttctgcatcgttctcttctttgtctgtcatagccattatcacagtatagtgtggatgcccgtttatctggttttgtaatctttctgaaagattataagagccgcaaaacagagactgtttttctatccctagtgcccagtacagtgtttgcataataagtaattattgaataatgtgtcatagtattagatggctgcagtatttttgagtgtttatttttcttaaatactccttttatctgttggatgttttttagtacatagactccattgatctggagaagatcactgaaaccgaggaccctgtgaaatttcatgaagcttggcagaagctatgcaaagctgagtgagtaccagggcccacgcacaccagttaggataggaccattgtactttttctgtaatgattcagtttaccctaattgctaattttcatgcattttgaaaggtagtttggagtacttgtggtctttgcaggtgattgttccacgatcatactgcgttgatttgaaatgtgccatgttaatgctggtggcatgtgcatagaaatggttttatttggggaggatggggatactgtgggaaagtgtgttgattctcctgaaggatgcagagggaaagtgtgttgattctcctggaagatgcagagatgaatcttacatatgcaaagttaaagtacaagaatgacagctttttttttctctctctttttacaaagtgaaagcaagtttattaggaaagtaaaggaattaaagaatggctactccacaagcagagcagccctgagggctgctggttgccccttttatggttatttcttggttacatgctaaagaagggatgaattatacgtgcctcccccttttagaccttatagggtaacttcctgatgttgccatggcatttgtaaactgtcatggcactggtgggagtgtagcagtgaggatgaccagaggtcactctcattgccatcttggttttggtggcttttagctggcttctttactgcaacctgttttatcagcaaagtctttatgacctgtatcttttgctgacctcctatctcatcctgtgacttagaatgcctaactatctgggaatgcagtccagtaggtctcagccttattctacccagcccctattcaagatggagttgctgtggttcaatatttcccctctcccttttataggagaactcttaatactaagggttgcagagggacaaagctccatcttctgtaacttcttcgtgttgaataggggcaatgacattcctccctattagagtctcttgtatttggggtagagaagaggtcagtcagaaagcgtcagatggcgagggccattcataactctgagttccaacaaaaggtgatatctggaagattaataaatgtttagtttaagaaaacattgagtaagcttattctgcattcctacacaaagagtacaatagcaatatattccacaacagtaaagcaaaaaattatcccaagtaaactaaattagaaggctttccatgaactgggcaactgttggaaccaagctgatatgcagttgctagctgatttcaatacatgcccagaattagaatactgatcccaatttttacgttacccatccctcttgttttttttttttttttttccgagacagagtcttgctctgtctcccaggctggagtgcagtggtgcgatctcggctcactgcaacctccgcctcccaggttcaagcaattcttctgcctcagcctcccaagtagctaggattacaggcacgcgctaccatgcctggctgatttttgtattcttagtaaagacgggtttcaccatgttggccaggctggtcttgaactcttgacctcgttatccacccgccttggcctcccaaagtgctgggattacaggtgtgagccaccacgcccagccctgctcttgtttttttctgagctgcagtcacagatcactgattgtttcacaggaataagcagggtcagtctaaattgcagaaaaaaacttcaaaaacaaccaataagactagaattcataataataacagttagaccatagttcttgaaacataattttttctctctccagtttcccattttcactaaagacaaatcatggtaagaacaatttgctttattatacttggcctgattatttgtataaagtgcagcaagaataattatttttcaataggcttttaaaattggctttgacagaaccttattccataaggaatctcagataagaccttttttaaagctgagcccacccatgggtttgtaccctcaaatacctatgaattgggtaaattcctctctttttgaggtcccaagataacttgaggctcctggacctgtcagaaagtgacattctttagttaccacaggtcagaaaccctgtacagggactgtgtagacaaggtatgaggctagttttcccacggggcttgtattggctttacaattcaagttcgattctttacaggaaagcacaccattccagtcaaagccttggtaatataaccagtttctccctccaattgtgtcctgttgcaaaataaaaaagattcttattgcacttatgcaaacaactatattgccataagttaagaatactcacaaattccaaatttcccaattctggacaaatcaggtagagagaaacaaatatgctccaaattttgttcacaggagtatactttactcaattgttacaagctgtatatagctcaaaagaacagttttcttgactccgaaaaataaaacaaaaaggatcagcaacattttaagcaaagtaaaaaatattaattttttattagttcattccatggagctaactcctgttctacttgatagtcatgaacatttcagctctccatgagagtcctgaaagattttcctctattctgctgtcacaatctccaaagttatcagaaacttgcatttaagaacagctgttagagttctatagttgatttttaactaccttctaaagaggaccaaaacaatacaattgtctgtgggtgacaaaatgttttagggcagccactattaaagccacaattgactaggaatttgttacatctgtggcttacaacaattttgcataacaatgataattattaataacatacacgaattcatattagaattatagaagtttcttataattttggaacacatacaataacatatttatacaaatacagcccaaagaaagccaaacaccatttcatatttgacagtgcttttcgtataatttttataccaaatataccaaacttcaccattgcattagtgcattaaattcatgtcaaacccaatttttaataaaaccttatagataaatctatccaattttagtttgaccataaggtaagatttttacaaaccttctataatcctttacaagttttttttttttttttgagacacagtctcttgctctgtcaccgaggctggagtgcagtggtgtaatcttggctcactgcaacctccgcctcatgggtccaagcaattctcctgctccatcctcccgagtagctgggattacaggcacccgccatcatgcctgactaattttttttgcatttttgtagagatggggtttcaccatgttggccaggctggtctcgaactcctgacctcaagtgattcgcccacctcagcctcccaaagtgctgggattacaggcatgagccaccatgcctggctcctttagaagtttttgttaaagagcagatcagcactctaagagaaacctgttgtgcttttatttcaatgttcaatttatggaaaacctgaatacacctttaactttagccaatgtccacacgcataatttctttttttttttttttgagacggagtctcgccttgttgcccaggctggagtgcagtggcgcaatctctgctcactgcaagctctgcctcctgggttcatgtcattctcctgcctcagcctcccgagtagctgggactacaggcgcctgccaccacgcccggctaattttttgtatttttagtagagacggggtttcaccgtgttagccaggatggtctcgatctcctgacctcgtgatctgcccaccttggcctcccaaagtgctgggattacaggtgtgagccaccatgcccggcctgcgtaatttcttttataagattaatccttcacaaaccttctacaacttgctcaaactttcagctttatcttatctaacttaaaataatccgttagctggatgcggtggcttacgcctgtaatcccagcactttgggaggctgaggtgggtggatcacctgaagtcaggagttctagaccagcctgactaacatggtgaaaccccgtctctactaaaaatacaaaattagctaggtgtggtggtgcatacctgtaatcccagctacctgggaggctgaggcaggagaatcgtttgaacccacgaggtgaaggttgcagtgagccaagattgcaccattgcactccagcctgggcaacaagagtgaaacttcgtctgaagacaaaaacaaaacagcaaaaaacaatcctttaaccttttaatctaggcaaaaaaaaaaaaaatccacattttcatgccttcttataatcttttactaaaaacacatttcactttccttatgcaacttgcatgtaaaactgtttcttcagtagtctcaattacagattacactgttaactcttaggaacttttacttttggtgaaaaacctggttagtaagcaattttaattacgtactaggtatggagcctaggacactagataaggtctgaccttttccagcatagctagggggcatggctttcaacttgtccccaagccttacctagaatctaatgctccaaagtaggtaaattgaacaattttcaagagtcaaagcagtttatgaccttaaagcattgagaaaacctaatatctgacctgcctaatttagaccaaatgtctttattttcccaataatctttaaagctgtttttattacccaaagattactaaagttatgtgaactaaaagtcattacaatttttacttttcttacacaatacttgatttaagctttactatttttaaaccaattaaagctttttttttttaacatcacacacacaacacatataaatgcacagacagaaagaagatccagtagttgtaagcacccaaatatcaatcagaaaggcttatcccctaaactaggaattgaaccctgaacccaggtcaccattgtgatgatggagaccaagagaaagtactgccacatggttgcaaggtcaagctcccaaggacatgaaacaagatgagagggaacccttatctagtttttcttcagggacctacagcaaagtttgttattgaccagtttgctggggtggcttgaacagcaggcttacaggggtcctaggcccacattctatcctaagacccctcattatgacagaacaatacagaaagacacacaaagcacaccagattcactgtagcttaagagtagcctcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcatgaacccgggaggcggagcttgcagtgagccgagatcccgccactgcactccagcctgggcgacagagcgagactccgtctcaaaaaaaaaaaaaaaaaaaaaaagagtagcctcacaaatcctttttaccattaatcaaaactttacacaggagacagtgatttttaccattcattcaaccaatttgcacagagagagagagaggccagaagtctgactggtaagaaattcttacccttttgtcggtatgctaggcttctgggttccctttccttgagcagccctagtgacccggctggctgcaccacagccctgggggccaagctgtaacacaaaggaaaattatcttttcctgttctggccagagcaaaatatgtgtgacaaaacatagacattagccactctgcctagcacccaatatcttactggcaaggctcaaacttgcccctggttgggccccatcatcattaatccaacctctgaccaggagtttcaacttgtctctgggcaagatggtcgccttgagtaacagaaaagatacgaaaaggaaaggagataaagggagaaaagcattgcccgcagcattttggggaaggcaaagagctcagggaggccagagaaagacgcacccattgcagtgacactgaaaagttcaggtggccgcttgtcggtcgtgaagggatcttttccaggagtctcatcaactctcaagtttccccttttgaggaggaaaaagctccccatgtcccatggtcctgtgcatgcctagttctgtcacccatagctatcagcaaagagtgcaaggcagaataatccaaagagaatagcaattaacatcccatagtgccaaacctattcttagcagagagggactttactgagagaggcctctaaccccctaaaccttaggaaggactctaaccttcctaagttgtgcctccaacccaaggtcattcaagcatccttgccttttattgagaggagcctttaactctctctgttttaggagagactctaagttgggcctctaacccaatcccatcctttacctgggtatatgcaccccatttacccaaagtcagccaattggtgcacacagacgattttcctttgggtctggggtctcttcagtattgttctttccgtgtttcactagaaagatgttactggaggctgggcatggtggctcacgcctgtaatcccagcactttgggaggctgaggcggtcttattgcctgagctcaggagttcgaggccagcctgggtaacatggtgaaaccccatctctactaaaatacaaaacattagctgggcgtggtggcgtgtgcttgtaatcccagctactcgggaggctgaggcaggagaattgctggaacccgggaggtggaggttggagagggccgagatcgcgccactgcactccaggcagggtgacaagagcaagactctgtctcaaaaaaaaaaaaaaaaaaaaaaaaaagaaaaatgttactggaccccaccacgtactcagtattgtcccttctgtggtcgctagaaagatgttaccagaaacgggtcccaatccagaccccaagagagggttcttggatcttgctcaagaaagaattcagggtgagtccatagagtaaagtgaaagcaagtttattaggaaagtaaggacataaagaatagctgctccattgacagagcagccctttctctcttgatgatattttccacatgtcttagattttaggttttattttgtaagtaattgacagaactcttgggggcagcattgcatcatgaggttagcatgatcctcctgggttttctgttgaactgtgttgctgttgtgtttgcctaggtctgtgaagtcttctagccaagaaattttcatttgccactacttaattagcatttgaaatcttaggctgatttttccaatttaactctttctgatgatgtcagagatcttaacatttttataatagtgttttgaaagaaccttaacctattttcattcagtttcttttcccagtggcattcttaattgaattgggtttctcagttagtatgctctgatgccacaaagacttatcgtaaaatatatattgaggtcagttgtgagaaattgtcacaatttcttcataacattgggaagatttcagaaaaaaagttcagggtgtgaagtcatataattggttctgaaaatagagcttgagcatagtcactagtgattggaccaagcattgcacgaatggctgaatacactagtttaaaaaaaaaatggatagtcaagtttaccctcattttgtattgatttcagtggtattcttgtgcctggaggctttggaatcagaggaacattgggaaaactccaggcgatttcttgggcaaggacaaagaagattccttttctgggtaaaactcatgtttattgaccctaactatgagtttattagatttttgacacctaggaggggtaacactaaaggtttgttatcgtaaaggtgtgaactcggatttgaaagttcaggtgccaaatagtctgctatagggtcaacaaactatattctaaatttggcccacagcctgtttttatgaataaagctttattggaacacagccacaccaatttgtttacatattgtctatggctgcttttgtggtccaacgtcagagtttcagaccctacggcctagaagctttactatctgaaagaggctagaatctttactatgtgaccctttacagaaaacgtttctcatcctaggagaacttgctgctattccagctgggtagcagaggctgggagaaggctccatctgcaactgtgcttaccttctccaattcccacctcagtctccagagtagctgggactacaggtacacaccactgtgcctggctaatttttgtgtgtgtgtgtgtttttttttttttaagagatggagtcttgctatgttgcccagcctggcctcaaactcctgggctcaagcaatctgcccacttcagactcccaaagtgtggggattacaggcttgagcccccgtgcccggccgagttgagcctttttaatgcttttttttcaaattgcgaagtacggcttctgtaccagggaaaccagaggaaatgggaccttgatgcgggagaggcagccctgtagctggggactcaggcaggagggggagtgcagagaggctgtgtttcccactgtgcagtggatggctgggtgggtttatgagcccattggacaggcttttagtgccagcagaccatttatttccccccattacctgctctttgattagcttcttagactctctcctcttaggatccattttcaaaatagaagactggagtagttacctggataccttgttttcttttactggtctaagctcgttgggggccattgtttttttttttgaagtttctgtctaaatgtgggtaatgttcctcagattattttaatagtatggaatggtttgcaggtctttagctttccctctagcatagcatctctttatgtcccagccatatggaactttctgaaatccccctcaccgccacccccaccccccagcactcagctgtttcctgcttattgacttctgttctggcatccctgatatattgattgctcccttctttgtttcccctgtgtacatcttaagtatctatcggaggagcatctgggatgctctttggcatttgtttagtggagagaattggtgaactgcagtgaaggcggagctgggtctgggagcatccctgtggcaacaggcttgggcgacacaggtctgccttccttcatcaccgagcactctgttcaggcccatcgtgtctccttccctgctgcccaccatgctcaagcccactgtggagtctccaacccccaccccccactgctgcttttccttacagtgaaggctatggggctgcctgtgggttagcagcctgacgtcctgtaggcactcaacctctggccaagcctgtgtttatggctgtgaagtcaccatgagaaggagtgggaaatcttagcccaggaaactccctctgagttggggtgttagatgttctctgaaggaatcaggcactgcagcccactaagatgcctcaactcagggacaaatctagaaggtggcagatttgtctcatggactctgcctctttctttccttctttccttccttccttccttccttccttccttccttccttccttcctttccttccttccttccttctttctttctttctctctttctcccttccctcccttccctccccttccttttccttctccttccttccttctttcttccttcttccttccttccttccttccatccttccttcttcccttcttccttccttccctccttcctctctctctttttattttctttttttttgagacagagtctcgctctgtcgcccaggctggagtgcagtggcgcgatctctgctcactgtaagctctgcctcccaggttcacgccactcccctgcctcagcctcccgagtagctgggactacaggcacccaccaccatgcctggctaatttttttttgtatttttttttttttagtagagatggggtttcaccatgttagccaggatggtctcgatctcctgacctcgtgatccgcccaactcagcctcccaaagcgctgggattacaagtgtgagccaccgcacccagctcctccttcctctctttctctctttcttctctttctttccttccttctttctcacccagcctggagcacagtggtgtgatctcagctcactgcaacctctgcctcccgggctcaagtaattctcctgcctcagcctcccaagtagctgggactataggtgcatgccaccacacctggctaatttttgtatttttagtagaggctggtttcaccatgttggccaggctggtctcgaactcctgacctcaagtaatctgctcactttggctttccaaagtgctgagattgcaggcttgagccattgcgcccagttgaccctgcacttttctgacctcatgttccttctttgtcaactttgggacttaggcggcttcatgatagtctaagcccctgccctgctctctgtcagggattcttctgagaggacagcagggagcaaaacaggcagagtcttgctctctgggagtctgcattctagataggggagacaggcagccaacaaatgaacagaaaatgtgaacaaatacaaagtgagttcatttgctttgcatatgtgctttttaaaataggagtttgtcttgggatgcaactagcagtgatagagtttgcaagaaactgccttaacttgaaaggtaagttcgaggtttgctaatgaccatttatttaaaaaattttctctcttcaaatatttttcagcactattggtgaattactgaactcttttcttaatcttcagatgctgattccacagagtttaggccaaatgccccagttcctctggtaagtggcttgtttatctttctgggtccagtcattgtcacttgggtcctggctcttgcctaaattcataaggggctattggctgggcgccatggctcacccctgtaatcccagcactttgggaggtcaaggcgggcggatcacttgaggttaggagttcaagagtagcctggtcaacatggtgaaacccctgtctctactaaaaatacaaaaattagctggctgtggtggcagatgcgtgtaatatcagctactcgggaggctgaggcaggagaattgctggaacccgggaggtggaggttgcagtgagccaagatcatgccaccgcactccagcctcagtgacagagtgagactccttctcaaaaaaaaaaaaaggcgggggggggtctattattattttttctttacagcaccagaacattttaaattacattattcttatattaaattcctttgttcttgatagtccatcttctcagctatgccttaaagacagtcacaatcctggactgatttctctttgtcgcagctttcaagcttaatgtttaggaaaggattaaatcggctgtgacaacaatttataacatctactataaataaatgagctgtcctgtctccagactcatcaccagtctgcctattttccacactggtggtcatctgtctttctaaaacaaaagcgacagtgattctgctgccagtcctcatcttccatcagtttcttttcccttaaaatattcagtccaggattctgggctgggtcccaaagccactgtgctctgtcacctgctgctttgctgattcatcccatggcatcctgattcctcccaggctttgagtttttttcttttttgtgtttttttgaggcaagttctcactctgtcacacaggctggaatgcagtggcatgatcacggctcacggaagcctagacctcccggggtcaaacaatcttcccacctcattttttgattttttttgtagagacaaggtctcactatgttgcccaggctacatgctttgagttttacgtttggacaatctaaactagtttttcagatacagcctgaggttccctatacctgagatgtccacctgcctaaaatccctctccccctggaatctcaataaaagcattgaaaaatttaattaacaacaactcagttaccaacaacttcctattcatctgaggaaacctttcctgacctcttttctttacctgcctctgccttctgcctcatgctactgtgctcaccactaacagagcgagttctgcaagatgatggttggccttcagtcagcctgtttgccagccacccatgcacacccagtcgtgtccctgctgctgggcacctacttctaatggagctcgcgcctcacaatcgcgattggttttttaaacagctttattgagatacaattcatataccacaaaatttagccatttaaactgtataatccggccagatgcggtggctcacgcctgtaatcccaacactttgggaggcctaggcaggtcaatcacttgaggtcaggagttcgagactagactggccaacaagttgaaaccccatctctactaaaaatacaaaaaattagctgggcgtgctggtgcatgcttgtaatcccagctgctagggaggctgacacaggaaaattgcttgaacccaggaggcgttggttgcagtgagctgagatcgtgccattgcactccagcctgggcaacagagtgagactttgtctcaaaaaacaaacaaacaaaaaactgtataatccaatggtttttagcatattcacggatctgtgccactctcattacaagcaattttgggccattttcattactccaaaaagaaaccccacacgccttagctgacacccccaagcctcctatctccaccagccccaggcaaccattagtctaccttctgtcttcatagatttgcctgtttgaatcatttaatataaatggaatcatccaatatgtagccttttgtgactggttgcttttacttaggataatgttttcaaagtctgtctatgttgtaacacgtatcagtactttgtttctttttattgctgattaatatttcattatatggacatgaaacattttatttatccattgatgaacatctgcattgtttctactttttggcattgtgactaacgctgctgtgaacattcatgtgcaagtttttgtgtggacatatgttttcatttcaccaggagtggaatttctgagtcatatggtaattctgtgtttaaccctttgaggagctgtaggactgttttccaaagtggctgcaacattttaatttcctgccagcaatgtatgagggtcctaatttgtccatatccttgtgaacatttgttatttctgtctttttgatgatagccatcctagtggatgtgaagtggtgtctcatcgtggctttgatttgcagttgcctgatggctaaggatgttgagcatcttttcatgtgtttattggccacttgtatgtcttctctggagaaaggtccattcacatcctttgtctattttaaaattagggtatttgtatttttattattgagttgtaacagttctttatatattctagatataagttccttatatataatctgtgctatcggcatttgggaacacatcattctttgttgtatgtgggagctcctgcccactaggtgccagtatcactccctaacccctgcccaactgtgacactaaaagtacctccagatattgtcaaatatctcttgggggcaggggcagaatcgccctggttgagaaccactgatttagagaaatctagttctatttctgtcccctgtagcctgtttaatcccttcccttatggcaagcattcattcttttttttcttggttcatcttcccattttttacatataagtaaagctgtatgtctttgtcatccacttcccttcttagggaaatggtagcatactctacacagttttttcctgccttgcatttttcgcttaacactgtatgctggagatcaccccacggaagcacatagaagcattcttcactctttttttttatagcttgtaactcaaaccataatgaaccataacttaccagccagatggtacttttaagtcttatgctcagaaggcctaataccaatgaagggttccttatgagcctttaatataaacatatttcctgactaatagctgaaatggctgtgccaggaaaactatgggttttcttttctaagatatactttgggataggaagtgattttaccagtaggtgccactgttagatagtgttggcaaggttaattctttgatgattattctttactgggggtgtgtgtacgtgcgttaaaaaatttttacacatggccgggcgcagtggctcatgcctataatcccagcactttgggaggccaaggcgggcagatcacaaggtcaggagatcaagaccatcctggctaacatggtgaaactttgtctctactaaaaacataaagaaattagctgggcgtggtggcacgcgcctgtagtcccagctactcgggaggctgaggcaggagaatggcgtgaacccaggaggcagagcttccagtgagccgagattgcaccactgtactccagcctgggtgacaaagcaagactctgcctcaaaaaaaatgaaaaaaaatttttttttacacagagtaaaaaagttaagccctgcagaaaaaggtacagaactgtctctcctttgcccccacctcacttcggttcccttccccagtggcaactactttgatccatttctttctttctttttttcctttttaaagagatgggctgtctcactatgttgcccaggctggatattcacaggtgtgatcatagcgcactacagcctcgaactcctgagctcaagtgattttcccacctcaacttcccaagtagctgaaactacaggagctcagctgatgcatttctttagttatttcagagatttgtgtgtgtgtttttgtgtgtgtatacccacttagccacacacatatgaatatgtattgcgtttaaaaaaaagatcttggctaggtgcagtgtctcatgcctgtaatccctgcacttttggaggctgaggcgggaggactgcttgagtcttggagtttgagagcagcctgggcaacatagttacaccttgcctctacaataaataaataaaattacctgggcatggtggcatgcacctatagtcctagctactcgggaggctgagggggaggatcacttgagccccaggggttgagctgcagtgagctgtgatcacgccgctgcattccagcctgggtgacagagcgagaccctgtctcaaaacaaaaccaaacaaaacaactttgtagcatgctccagacactgttcccaccttgctttatatactgatcattccacatcaatgtgcagggatgtcttcggtgtgcttgctctgctgtatgctatatggctgcatccttatttatttaaccagtctcatatttagtttgtgtccattattttgctgctttaatttatgctgcaaattagtatccatgtacatatatccttgcacccacgcgcgaacacatctgcagggatagattcctagaaggggagttgctaagtcagaggatgtgtgcattttacattttgatggctcctatacacataagtgagatgagaacaataaaagctaattgctattgaacgtctttatggcctgcaatgtttgttggagaaaaatagccttaagagctagcacttgtatcgatgtgagaagtcttattaaaaaaaaaaaaaaaaagactaaggagatagaatcataaggcagcaagcaccatgaagcctgcagagttacttaagcttgagcaaataacagttactttgtggggactggtcattctggctgttctagctaggaaagtaaacagtttggaaaccaggagccttctatagggaatatttactcctaagatctcttcataggtcatcatgaccctcctttggcatgcatgattagtgctatggctgttgatgaaatcaatagagacactggcatccagaacagttccaagagaaagtgtctgttatacacataaaaagagaaacagatttttccctaagggttaaggtagactctttctgcgtctcagagtgcccaggagagaatgagtaaaatttattttattgtgtcatttctctgcttaatccacaaggtgaaattgaaggctctgggactttgcagaatacttagggttctatagcaactctggttttttgccctgcttcaaagtagtctcagctgccttctagatggtacataaccaagagcgtagctgttgctgacttacattctaaccctatatcaatcacatggctgctgctgacatccttgaccttgaatttggcttcagatctctccagtacatctgtagtgtagttcacagcactttggactttatattttgaatattttcagcttttgaggcatatatatatatatatatatgaatgaacaatctcaatctaatgtgtaggcatgtgaatgtgcttaactctaagcatttcttttctgtttgttgaaaaaggtaactaaaaattctaaatttacataagatattacaccctgaagacagaattcatgttccaccttcaaaagacatcagcacacacatgcacacttggatggtggtatgggaaaggaacagggagaaattcaaagcattttaacgagatgcaaatggatatttgagattttggtatttgatattatttcagttttcattatttatcataggtatgacgtcatttatccctttttgatccaggaattttcagggttaagtgaattttacatctaccatagtagatttgtgaaacagtcacataattaaaagctgatttgggtgaaagttgatttttgttatacatgaagtataattgattaatgcataacattttcctgcctttagttgaagccctgtttaaaatattttcctcatctgtattatttttcaacaacttcatatggagtgcaaattaagaggtgttgaaaacaaaccagatggcccacttagaattatcttttaggcaattttgattactttgaggattttcttgcatttagagtgttgaagtaagcatctcctgactattacaaagatcatatagaaatcacttggaggttagttagggctaaaaatcctttttcccataaaagtagtcattaggaatacagctataggccgggtgtggtggctcacacctgtaatcccagcactttgggaggctgaggccggtggatcgcctgaggtcaggagtttgagaccagcctggccaacgtagtgaaaccccgtctctactaaaaatacaaaaaattagctgagcgtggtagtgggtgcctgtaatcccagctactgggaggctgaggcaggagaatcacttgaacctgggaggtggaggttgcagtgagccaagatcgcgccattgcactccagcctgggcaacaagagcgaaactctgtctcaaaaaaaaaaaaaaatgcagctataatatgggttaaatagctttttacagaccactctgggagcctaatactcctttgatactgtctctgtggggatagtaggtttagagttgacatcagactgttggctgaggtaacttttttctactcagagaaagaaaagttcttgcctgggcacggtggctcacacctgtaatctaagcactttgggcagccaaggtgagaggattgcttaagcccaggagttcaagaccagcctagtcaacatggtgatacctcgtgtctacaaaaaaataaaaaagtaatcctggcactttgggaggctgaggcaggtggatcacgaggtcaggagattgagaccatcctggccaacttggtgaaatcctgtctctactaaaaacaaaaaaattagctgcgcatggtggcacgtgcctgtagtcccagctactcaggaggctgaggcaggggaatcgcttgaacctgggaggtggaggttgcagtgagctgagattgcgtcactgcactccagcctggtgacagagcaagactgtctcaaaaaataataaataaataataaaaaataaattaaaaagttagctgggtgtggtggtgtgtacctgtagtcccagctcctcaggatgctgagatgggaggatcacctgagcctgaggaggtcgaggctacagtgagccatgatcatgccactccactccagcctgggtgacagagtgagaccctgtctaaaaaaagaaagaaagaaagaaagaaaaattctcctgaaagggaacccttgcacactcttggtgggaatctaaattggcattactattacggaaaatagtgtggaggtgcctcaaaaaattaaaaatagaactaccatatgatccacttatcccactactgggtatatatccaaaagatatgaaattattgtgttcaagaggtatctgcactcatgtttgttgcagcattattcatagtagccaagatacagaatcaacctaagtgttcactgatagatgaatagataaagaaaatggaaaatgtggggtgtgtgggagaaatggggagatgttggtcaaagggcacaaacttgcagttataagatgagtaagttctggagatctaatgtacagcatggggaccatagttaataatactgtaatcccagcacttcgggaggctgaaatttgcttagagagtggatcttcattgctctcatcacacacacacaacagtaactacgtgaagtgatgaatatgttagcttgctcgtggtaatcattccacagtgtatacagagatgaaaacatcttgttgtacaccttgaatatatacaattttttttttttgtcattctgtgactcctacaccttcttactccctttgtgaccttgggtggactcagcatggtgaccaaagactttcatgatctgaagtgggtgtgccctcttcattcctcatacttgacattccaccccaaacatggtgtacacattctttaaacagccttgcatttgggcatgatgtgtttgcttgggctgttttctctctttctgaatgcccactgctgcccctttcctgcatgctcccctcaaggttctttctacagagcccagttgaaatgctacttttttgatgaatccttcccctgacctggtcccaaacttactgacttagaatctcagaggtctggaaatttgtgtctctcatggcatcttgtatagtgccttgcccataataagtactttatatatgttggagttgaaatagataatgtatattaactctgcgaggggctaattgatacctagaatgaacataggctaaaatgagaagctagcatgagctagatatcagaactgaacaaaacacacaccacaaataataaaaactcaaaccatagactaacgttggttgggaatgaagatatgaaaaatctcaaataaaatattcgaacatccaatttaacagcattaaagaatgatcatgactgagtagtgtgtttatcctgggaattaaattaacacattatattgattgaacaaaagagagagactgtgtagcgccatacatgctcaacatcgaaacctggtgctcacagtctcataatgaactaggaagacaccagtacttcttaaacaagaagaatatcttccacaaagcagtagccaacagtaaagttcatggtgaaatagtaagggattcttattacaactagcaacaaataaaaaatgtgcaccatcgtgaacaaaacagttgttaaaatgagaccagcaaatgctctctgggaagtgaagctggcgttctccttcctgcctgtagagttatgaatccatacaaccttttgggaaatcagttaggtggtctgtttgacaaaccatacaaatatccataccctctgactcagacatttacttctcagaaattctcctaaggaaatcagaaatgttgacagaaatatgaataggtactcattacatttagaagaattagaaatgacaacaatctactcatcataacatttggaagaatcggaaatgacagcaatctaaatgccccacaatggggaaatagttaagattattatggggtatctgtacagtggaatgtaatgagtcatgagaaatgtttaagagttttaataccatgagaatgctcttgtgttgaattagaatgatacaaattgtatttaaacagtccctcaactgtttataaaaatctcctctgtttcttggtgggttagaaatcacctttttttttttttgagatagagtcttgctctgtcacctaggttggactggagtgcaatagcacaatcttggctcactgcaacctccgcctcccgggctcagataatcctcctgcctcagcctcccgagtaactgggattgtaggtgtgcgccactatgcctggctaatttttgtattttttgtagagacagggtttcaccatgctgcccaggctagtcttgaactattagactcaagcgatccacctgcctcagcctcccaaagtggtgggattacaggcgtgagccactgcgcccggccacctttctatttttctggttaactttctaaatgtttgaaatggcttccaatgaatttcattttattattgggggaaacttccacacttattttctttcttcccaaatctccacaagtatactctcctcccaaaatttagatagttgtatttttctgattattccaaataagagtgctgagaggctaatcacaaagagcagcagccagagatttacaaagtgttctcttactattgaacattttcacttattctttttgataggacacacatccatatggctcagaaatcaaaatgtccaagaatttgtcaagtgaatagtggctctcttattcctgcccccccatctgcccagtcctcttgaagcacgtaaccaatgataatagtttctactgtgcacttgcagagattttccaggaaatttcaagcaccttgccttccaagtcactatataccagctactcatctcgtgcccagttcactttggtcaccctgtccccaccatccctgtgcttacatcaaccggtacttctctctctctgagctcaaacaccccagagagaagcctggccctgcccagccttttatgggtagatgaggtgggagcatgggtacgtgttcctttgcccacctcggagagtcatccagcttctggaaaaatgatagcagccaacttgacagaagaacccagcatacacattcaagttcattagattaaaaaaaaaaaaaaaaaaaaggccgggcatggtggctcatgcctgtaatcccagcactttgggagacgaaggtgggtggattgcttgagcccacgagtttgagaccagcctgggcaacacaggaagacccctgtttctacaaaaagtaaagaaaaaaaattagccagtcatggtggcacatgcctgtagtcccagcttcttgggagactgaggtgggaggatcacttgagcccaggaggtcaagactgcagtgagccctgaaagtgccaatgcactccagcctgggctaccgagcaataccctatctcaaaaacaaaacaacaacaaacaaaaaaacacaaaaaaaccctgaaactaaaaataagtcaaaggcagtactttgcaggcagttattttcagcttgaaggtagagccgtatagcagaatcttggagagggcttatgttgtttgaaacgccttcagtatcatcattttctacactttgaaagtggaaatgggccgggcatggtggctcacgcctgtaatcccagcactttgggaggccgagacgagcggatcacaaggtcaggagatcgagaccatcctggctaacacggtgaaaccctgtctctactaaaaacacaaaaagaaaaattagccgggcgtggtggcgggcacctgtagtcccagctactcgggaggctgaggcaggagaatgccgtgaacccggaaggcagagcttgcagtgagccgagatggcgccactgcactccagcctgggcgacagagcgagacttcgtctcaaaaaaaaaaaaaaaggaaagtggaaatgatcccatatctttctgatgttaactacagaaagtatagtgtggcagtctgggctctagagcgcgaggtaaaaataataaatggcttgaagaacattgttcaaaggcatatcatgtacaattgggtttttgatggggagggcagcagtggggttaaaaaaaatctcatgtctaaagcacagatatgtgcacagcacataaacagatgcacaagacatctctggagttaaaatttcctggggggtggcgattagaaacaagtgtttaacaaagctccttaggaggttgataatggcttaggaaaggttgagagaggccgggtgcgacctgtaatcctagcactttgggaagctgaggcgggtggatcacctgagattgggagtttaagaccagcctggccaacatggtgaaaccccgtctctactaaaaatacaaaaattagctggatgtgggggtgcacacctgtaatcccagctacttaggaggctgaggcaggagagttgcttgagcccgggaagcggaggttgcagtgagccaagatcgtgccactgcactccagcctgggcgacagagcaagactctgtctcaaagaaaaaaaagaaaaaaaaagaaaaagaaaaaaagaaaggttgagagagactgttcaaaggcaatgggacccaatactgatactttgatacttcatgggtgttttgcggaggagagttgcgaggataaagaagaaataaaaatctagcttccggggcactgctgtgaccaggctattagggtcagcttgagccattggtaacttggacaaacttgaacgttaacatttgaactcttatctggtaaggggtagcagaaagttcccttccctccttgaacgttaacatttgaactcttatctggtaaggggtagcagaaagttcccttccctcctctgcacttcttgcctccatattccacactgttgtcacttcaccccctgcatcccctagctggacgcaaaaagtggaacttgaacttgagggctggctgttttctcagaatacaggatgccaagagttgagagggcccaaggtcttcctgtgatcttttatattacacgtcacatgccagtaccatggcgttaggctggtagacccgaggccacccggtcagtgatgagtggggccgcctctaggtcctgtgttccttctgttccccgtcgagggtcattcattaagaaagcacagcgagtgctgggagatagcatgacgtcaactgtctgtttgtgaagtgtttttcttgctcgctagtggatagtgtgagatcagagtggaaattggagatgacctgagcactgaggagttaaggaaggagagcaagcaacagggtgattctggtggaaaagtggagcaagggagttggtttggcatttctggattcttttcaggtctcccacaccatctttgtagttttcggcaggatcacagagctatcttggccctcacattttatttttttatttttatttttattttgttttatttttagacagggtctccctctgtggtccaggctggagtgcagtggcgtgatcatgtctcactgcaaccttgacctcgggggctcaagtgttcttcctgcctcagcctccctctctctctctctctctctctcttttttaaatctatagaattagttgaatcagactaaggttactttcaagtctattatgttatgaggtcagtacttaacaaagtaaggtatgtctaataatttctttattaataataactgaacctcacagccaggttattataattgcaaagaattaaaccagagactttgggggattccacataggataagaccacagcacaggcgctcttcctccagtgctcagggttctattttgttttctccttcactgggatatcttttttactaatacttggaattcttcaaaactaacttctccatctccattcttgtccagttcttgaaagagatcatctagggtgtttggaccctgttttacataaaaaaggatgggagaagggaggggagaaaaaatgaatcagttactgctacacattctcagaaattagaggccttggggtctgtgtgccaagaaggcagctcaggtttccagtgacatgcatctaatagctaacagagagaaaccagctttagctgttgtattgctccgtgtcatagaactggctacctttttgtcctccatatcacacatctgttattttaatacaatgcgtattttaatacagttgttttcttatgcgatcttgggtctttttctttatgcctctaaaaacattcttctgagaagggatctgtgggcttcactggattgcccacggcacacaaacagttgaggacccctgccccaaggttttcctggaagctgggtttgtctcctgctccagggctagggctgacatattacatgaggcagcaggcagggagggctccttctgtaatccttccgaccaccctatgagggagatctactttacaggtggggaaacaggctcagagacaggcagtcacttacttgagtgtccacagctggttaacagaggggttggggtccacacgttgactccagagctcaaccccttaactaaccaccgcccagtttttcccaaacgttgagctatgcaaaatgactttggctcaatggttcccatgctttagcatgcatcagaatcacacgataggcttgctgaccttagtaaatacagactgccagccccacctccagagtttctgattcactaggcctggggtggggcccgagaatctgtacacaaggtcttgctctgtcacccaggctggagtgcagtggcatgatcacagcccactgcagcttccacctcctgggctcaaatgatcctcctgcctcagcctcccgagtagctgggactaaaggcgtgtgccaccacacctggctaattttttaaaagttttaatagagacaaggtcttgctgtgttgttcaagctggagaatctatattttcaacagcttcccaggtggtgccaatgctgctgctctgggaccacacttggagaaccactgcttgagatgtcgtgtgagatcgtgtgcaggctttttgactactggacttcctgcagtgtcttaagtggagttaatttttgtctctaccataaaactctaatcttaaagccattactacttggactttcaggtaggagtctatctgtgcaaaatactacttagaaaaccgattgaaataacagttcagtttgtcagtttcaaattagactatattatatatatatatgtatatataaattgtggtaaaaaacacataacattgaatttacgctcttaatcatttttaagcatacagttcagtagtgctaagtagattcacaattttgtgcagcacatctctatggaagatatattttaacccctaagattcctacaaaaacacttagcactttgctttaattacaagaccaaactgtaagttacttattcagcctttgatttatgaatatgaaacactgttttcctgaagcctttactagattctaaaccatgcatggtgatgatatatgtaaacagagtatggtggaaaaccttagtaatggaaaccttatgggaatataatcaggtacatgttaagtagactttcagaacttaccattagtcttcctacctcgttccagattatgtcttacgtactttttgtaggaaagacataaaatatagaaaaagttacccgtgttaccttttgaaacaacttgtttgagtacatggcctaggctttcctgttagatgattatttttcttccttttagaaaaaataaagggtcttttaaaattttaaattttttcactaacttgttttgctgtttaattaaaaagtccctttttctgctagtgactttaagtgtttttacaagttcttctatatttcaactatgagaaaatgagaaaatatcagattctggggtcattgaattcagcttttttcttttttagtattaaaaacagaagtctttccaattgtcatattggcagaagggacatttctggttaaaatctggagagctggttaaaatatttgaagaaatgttctttcctgaagttagagctaaatagtgactgagtcatacaaaacaattccatagtcacttctgttgtgaagatggtttttaattgcaaaatgacaatgactctctcctttgagtcctctgctcgactaggcctgaccttgggcttccctctctgtccttgtatctgactacccttaatatttgatcacctggcctgccttcagctagaatcctatcaaggcaatttagccagaagctccttatcctggatatttccttggtaattttccatccactggccccccccatcctgctctatggtcataaacccccacttatcctttctggagttgagcccaatctctctccccatggcaagaacacgtttcagtggtccctgtatgggtcgccatggccctcctggagtaagttgccttaccatccttggcaagtgtcctgactcagctttttctttagcaaaaggaaagacagtactgtatattggagtgaggacgatcagctcttctctgtactctgttgccttgaatgcattttgattttgacaactctggggtgattttgatgtgaaactttatggcccaggaaatttagtcctttcttgaaagttgtttagaaatgcacggttgcctcattaacacaaatttaagtgatgaacacaaatgtaaatgcttttgaaatataaatgagtgctgacaaggcaatttgtcagtgggttttcctaacagactgctaagtaagtgttggtcttgttgagggattttacatacacaaatgaagcctgtccaaggccagctaacactattttgcagtcctctttgttttcctaaagcctggcacagaagtactgaatccatgctgaaggccttattgggtttgcttggtgacttgtgggtcttccaggcataacttggcattgcttccatttattatggctagtcctgcagagtcctgtgctgaggctgcaggagggatagaaggcttggcccttgttttctgagagcttgccttctgaaatgtggcctgacttaaggggaagaaaccccacctgcatgtgtcctccctcaagcgacggtccctataaggctctaccggagtcctctcccctccctccctcccctcccaccatcagtcccattaagtgggctctgcggatggccacttactttgagtaaactggggaattcagcctgaatcaatagcttcagttcatcctttgacaactggtctggatcaccttctttggctgcatatttttcaaaaatcctcttcagttcctcaggagactttttagtactcattctggtgtcttataaattgggaagaaaataaacttaccaaaaagctgaagtacagttttgtgctgagggttgtctgcaggattttagtgccattgggccatttccttggcataaatggggaagaataaggaaaagagaatgtcggggtcggaatggcaccagtaactactaacatgtttaaaaaataagcatcttaggccaggcacggtagctcatgcctgtaatcccagcactttgggaggccaaggagggtggatcacttgaagtcaggagttcgagaccatggaagcctggccaacatggtgagaccctgtctctatacaaaaattagccaggcgtggtggtgcgtgcctatagtcccatctacttggaagaccgaggcaggagaatcgcttgaacccgggaggcggaggttgcagtgagtgcgatgccactgcactccagcctgggtgacagagcgagcctccgctgcaaaaaaaaaaaaaaaaaaaaaaagacatcttagatagtatgttaaatgtctgttcttagagtacatctgttaggagatggtccctggagccaaacatttttattagtaattaatgacattctacactttttatgtacctgatctgcactctgcaggctgtggtcttgaagaatacttgaccacagcttctagcttctaagttacagggaatatctccagatggcataaactcaccttctctccagaccattatctttcacaccattctaaaaggaagcagagtattaatgcaaacagaaggagctctaggtagtaccaaaatcacactaacctggttgcccaatagtgaaacagctagaagaatcaaagaggagtttgaagagctgagcagaatcatgacacttttatagtctttacgggcacgccaccctgattatgaaaatttccttttgttggccatttaagggtaattattaatggtttttgaaactcaggcttaagactgcatgaaccccataattaagggcaagatccagtaaaggtccatctcgacagttgcttcatggttcagagtcgtaagcttggatttttttccccctgagattatattttccctccaatgtagaattatatttgctcacagttcacatttcataaagcttagatatagaggattcttttcaatttagttgcatatttaggctttaaaaaataactttcttcatatccagaaaaaataaatgctgccctgtgcggtagctcatgcctgtaatcccagcactttgggaggccgaggcaggaggattgcttgaggtgaggagtttgataccagcctggtcaacacagcaagacatttctactgaaaaatttaaaaaatcagccaggtgtgatggtacatgcctgtagtcccagctactgtagaggctgaggtgggaggattccttaagcctgggaggttgaggcaacagtgagccatgattgtgccactgcactccagcctgggtgacagagtgagatcctgtctgtaaaaaagaaaaaatgctgtcatagaaggacaatattacatagtttaaaaaattacggtatggccattgaagtccttctgatgtctttacatattagcagcttaaatatttgaatacatgaatgaatgaatggaagtattgcttcagaagcaggtttaagaagtggaaagaagatactcagtaatttgtggttttatttggcaaatcaatattgagtaacatggtcattttttcagctctttcattatttgttggtcctgtgtctgctttttatttctcattatccttttccttaccaaatatatttcgtgatcattcgaaaaacttgtgagaacactcgacttactcttgttcagttggaaatacttcaaactttttgtaactgccatgatttaaaattgccaaggagattgatttctactggaaagagttccatgaaataagtaggacatttccaagggacattgatctaatgctgattgtaactcacaggaaggggttccaggtggattttaagagcactttacagctttgaaacacttgtacacttccacacttatagaattttccctgactctgccttatatcacctacaaactgaggactggactattgggactgtatttctccctgatgtttctcagctctaaaattctagggccttatttacattggagaacaaatgggaaatctaatagaattccttaaaagcttcccgccagtcttgagcatttatcattccatgtgtctttgctgtcttgtatatattcttcttgtttttattatggattctttgactttgctatgcaccaatatagaatatgtattaactcactggttggagtaaagacaggcattttatttttagttataagattttacacaaaaatattctgattttggcaatgcattttaatcaagattttagaaaattgccagtgtttttacacatatgttctgttttcctgggaggaagtaggcgtttgtgcttaatcataacaagaactatctttttttaaacatcttttaaaaaatatttcagatctacagaaaagtggcaagaatagtgcaatgaacaccagtctgcctttcgactagattcactaattgcgaacatctccacatttgctttctctttctctggacagatactttcctccacccctgagtcatttgagaatcaattacaaacatccagatgcttcccccctgagcacctcagcatctgtctcctaaggacaaagacattctcctatgtaaccacaatgccattatcatagcccacgtcaaatctctccaattgttgaatagcatcttaaatcatcttttctctcaaattaccactagtgagctaaaatcaaatggggtgtttattatgttttgcatctggtttttttgtttatttttttgaagccacttcactgtgtcactcaggttggagtgcagtggcgtgaacacagctcactgcagcctcaacctccatgggctcaggtgatcctcctacctcagcctcccgagtagctgggactacaggcatgtgccaccatgcccggatacatatatatatattttgtgtatttcttgtagaaaaatacaacatgggttttgccatgttgcccaggatggtctccaactcctgggctcaaatgatctgcccgcctcagtctcccaaactgctgggattacaggcgtgagccactgcacctggcctattttttgcatctgaagaaatgattttaataactatatgtcatcttagtaacgatataggatgaaagataacatgttctatataatacacccatatattacatatgacgtgtgtatgtatatataaaaattatctctaagaaaaacttttggagcagtattggttaatagtcttctaggctacaaatctcttctttcaagggacaacttctgattagaatcagcccaatgcggccgggcacggtggttcacgcctataatcccagcactttgggaggccgaggtgggcggatcacctgaggtcaggagttcgagaccagcctgaccaacatggagaaacctcatctctactaaaaatacaaaaattagccaggcgtggtggtgcatgtttgtaattccagctactcgggaaactgaggcaggagaattgcttgaacccgggaggtggaagttgcgttgagctgagatcctgccattacactccagcctgggcaataagagcgaaactttgtctcaaaaaaaaaaaaaaaaaaaaaaaaaaaaagaatgggcccaatgctgcctattgtcagaatttatacttgtagcgaatgctagcaaaacttgaacttgaaaaacagcctgtgcggcttcttaagtttttacttgctcacttctaccagtcacatctcttgtctcttatttttctctttacccatagacttaaaagcatgagggtaaacttgcacttggaagcatgaaaaatccactaatagatactcttgtgaaacattaactaaaaatatatggagacaagtgataattacagggtgtgttcacaagagtgcgttttgaaaccagagaaggggggaaacgacaggcacaagggtggtaatgggaaaatggagaggcaaaggttatttatcacctcactgttcaattgtttgatctttggacaggcttaatttttcctaggaaagccaagagtaacatattttaagagctctgggcaccacaggcttctgtgggttattctgcttgaaggtgacagcatgcaatgtcttgaaaagcaccttcaggaagagggtacagtgttagtacctggtccctgcaaaacaaaatgggtgtgaaatgctatccatgggttcttgttatctttgatcctgaagtttaaaagagaccttgaatactcaaatgctgctttcccagaaagtatagcttgcttgtcacctgacctggtgtctaccttccctggaccttcagacaaagttcacttccaacctttgcctgggctgtgaggctcactgtcttttgggtcagcctgtgctcaccttcagcagttgagttcccagaggtctcctgaccatagcctgtgcttcttgagtgcgtatctttactatgggcagtgtgctgacctaggcacccaactcccacggcctccttaaatccttgctgcaactttatgaagtggatgctgttggtccccccagtctgtagagacatccaaggacctgctcagggtcacactgctggtcagcagtagagctgggattcaagttcaggcccagcctgcaccctcaaccaccgtgccacatgcccctcccaggagaagggcttctctgaggacaaccattgtatgttaacattaggaccacaggtagtatcacacttaagtgttaggtttacatctggaggtataagaaggttctttttctgaggtgtaagaaagttcttttcctgatgaaaatgatataggcctttgtctgttttgcactgctataacagagtacctgagactggctaatttataaagaagagaaatttatttcctcacagttctggagggtggctgggaagtcccagatcaaggtgctggcatctggtgagggccttcttgctgtgtcatcatgtggtagaaggcatcacatgggtgagagagagggaaggggactgaactcatccttttaccaggaacccattcccatgataactaacccattccaatgataatggcattaatccattcatgggggcagagcccttataacttaattgcttcttaaagattccacctctcaacactgttgcactgaggattaagcttgcaacacatcaactttggggaatgcattcaaaccatagcagctttcttttactggtggggaaaaaaacaagtttaaaagactggaaaaatacatacgtacttatgggactgctcattgatttcctcattgtagattccattctcacactacttggtgacacagcagcgcaggttggaagccagaaatgggaaataaactgcttcaggttagaggcaggactctgtcaggcaggactgggcatagtgtgtactcggcctctgagtagggcaccacccctcccttcccgtctgctgaagagactcacctgcaacttgggacatccatgagtatctcagacacccctctgctactctgtggcccactgacccatcccttagtctcccctgttagtttttaatacacttaaaacactgtgagattccaggccgggtacagtggctcatgcctgtaatcctagcactttgggaggctgaggcgtgtggttcacagggtcaggagatcgagaccatcctggctaacacggtgaaaccccgtctctactaaaaatacaaaaaaaaaaaaaaaagttagccgggcatggtggcgggcgcctgtagtcccagctactcaggaggctgaggcaggagaatggcgtgaacccgggaggcggagcttgcagtgagccgagatcgtgccactgcactccagcctgggcgacagagcaagactccgtctcaaaaaaacaaaaaacaaaaaacactgagagattccattattgagtacttgatctgaacttgacactgtgtcgaactcctcagtggagatggaaaataaaaagatctaatccttgtgcttgatgagcctacacttaatttatgagaggagatgcatttatgaaataatagaggaagttaaagctgtttgtagtaaataacggtattagattcctatggctgttgtaacaaattaccacaaacacagtggcttaaaacacatatacatttcttctggaagtcagagatataaagtgggttggcagggcagtgttccttctggagggtgtacgagagaatccatttccttgctttttccagcttctagaggccacttgcccacggccatcctccatcttcaaagccagcagcatagcatcttccagtctctctgatctctgctttgtggtcatatccccttttctgaccctgaccctcctgccttcctgttttaagagcctttgtggttacaatgggcccaccctgataatccagaatcttcccttctcaagagcctcaatttacaggctgggcatggtggctaattcctgtaatcccagaactttgggaggccaaggctggaggatcatttgaagccaggagttccagaccagcctgggcaacatggcgaaaccccatctctacaaaaaaataccaaaaaattagccgggcatggtggcatgcacctgtggccccagctacttggaaggctgaggtgggaggatcacttgaagccaggagtcagaggctgtaatgagctatgatcatgccactgcaccccagccttggagacagagtgagatcctgtctcaaaaaaaaaaaaagatcctcaacttaatcacatctgcaaagtcccttttgccacagattcataggtttcagggactaggatgcggatatctttagggtaggggaggcattattcagtctcctactatgagttactgaaaatgaattgatgatgtataggttatttatttggtaggctgagcataacaatggcattaattatgaggcagtaaggggaactggagggggcccctaaagcatgaggaatgggagggagaaggtatcttgggaaaagtagagaaggaggtggtctgtgtgtagtatggtggtgggtaggagagtggaggtgccattgacaatggccccagctagctgtggtagaagctacaggttcgaatacatgaggagggcatggctagtctgggctcctgtgtgaggtaggacctgagagccacccagaagagtttaggtttagtctgtagtgatggaggctgctggagctagcagtgcaacccaacattagggaaagtaatgctgatgtaaaactgcttgatactttatgtacaatttgaatatgacttagaatcaaaatcagaatcaggcttgaaaacctaatgagcagtaggaaaggaatgaattggagaatacttgtaaagaatactagaggaggccgggcgtggtggctcatgcctataatcccagcactttgggaggctgaggtgggcggattgcttcagcccaggaattcaagaccagcctgggcaacatgatgaaaccccgatgctacaaagtggaaaaaaaaaatgctagaggaaattgctgtatgttgcctaagagtctggaaatagaaatagctgctggtgagtaggctttccctttgtctccaggtgaaatattcaacgatgaggaacaaaaggaaagctgggcttaccagggtaggtcaggtaggtccagtcaggaatttcactgttgctaagagaacctaactcctgtagactttgttgtttaaggcacctgggatgctgtaaagtcttgaactcattacacttttattatgggctgcagaaaacatcagtaaaggttaattagtgccatatttatccttacatgctgattttacatctcctaaagctttatcacttattgatccttttttatttttctcatactatatggctcagttccaagagaggacaaatctggggatcagatgacagccagtatttaggctgaattagaggaagcaaaggcaatccttttgcaatggaagatgcgttttcctttcagatgcaaaaatctagagtattttggaaatgttggtgttaaatctaaagcatatttgagattattttctttaaccaccccagtaacaataaaatagatatgttttgaaactgtgatgttctcctgtctctcaggcttttagtggaaggaatgcaaggaacaaagacatttttgttaatttttgctgctgaatcaggttgcttataacccaagaggcagccagccatcatcatcttgtaggatccagcttgtaggatcatctgataactctgcaaggcagctggtgtgtcaggcttgggcaccatagtctctgccttgccctgaccttccgcttcctgagtgttggggttccaccagctggtgcctggcagcgttctttgcctgagtatgtgatggtgattcccagatgagatctcctaagctaggcccacacagaaccttcctgttccctccctccatcagcgacttgcctgtcaattctctccctgcttttctcctttcactgatgttcagggcaacatttggtactggagacctattttcacctgcttcccacctcttctctagcattttttgccttctccactggttcctacgctagcatgttttaatcagaggatcacagtggcatttataccttggattttctttctgtgctatcatttcaggagaaggtagcgtttattacttctgaaaacagcagggataatgtgaactaataccctagtgtaaggcctaaatactacattttactcttgatgacttaaacttgtattttcattagtaaaatacgatgtgcaaagtttaaaaagccaacagttctgaaaagcctataatgacaaagtcattaatcctcactccctctgtaccactctttagcttcttctagctctttctctgtgtttgtctccatgttgctaaataatctcatagtattctttgaggactttttagacttctcccgctttgttgaaggagtttttaatgctcttaggcagcccctatgcccactgcattttccttctctccccacctcccacccctacacttgacttttggaaatattttctggtcttcaagtgtttgtcaagttcatcccaagtaagcagtaaggcagatttcctgttctttttcttttcttttgtttacatttttgagacaaggtcttgctctgtcatccaggctggagtgcagtggtgtgatcatagctcactgcaacctccgcctcctaggctctagcaatctttccacctcagcctcctgaatagctgggactgcagcctgtgccaccacacccagctaatttttgtattttttgtagagaccatattgtccaggctggtctcgaacttctggctccagtgatctgtctgccttggtctcccaaagggttgggattgcaggcgtgagccactgcacctggcctcctgttcttagttggctaattttactctaatctcaatgcttcataccagaatatttcttgaataccaaccttgccagtaactgaacaaactacatgtaaagactcttcttgggtattgggtattgggacccaacacagtgaggaagactgaagagtcgtagtgcacttctatcaagaaattaggggaggttatccctgtagtctgcctagatggttcaggttgtctgaaacttaaatggaagttgaggctctgaatacacgtaggacttctgaatctgtggcaggtggtgcagtcttacctgatttagagaatacatagagaggccaggcatctatgtgcaactcagcttcatcggccagaagtgaatgccctatctcacctcactccagtaatacttaacctagccataattagctaaccaaagataggaacaagatgccaaggccaagagcacttgagaattgagcagtccatctaacaagggaggtcatcgagtttcttctccaccctttccctgaagtaactcttggagcaagcttgggacactgtgttcagatggctcggaaagttctggggcactgataagatcagacattttgttgggaattttttacctcagaaaattccagttgtcaaagattcctgtagagcaatatgtggcaattacggtatgggaaaaaaacaacaacaacaaatgaaaggttttatgagagggaagctcaagcaattccattagaacaggtcgactcacccaactgtagtctgttctaacaactttaaaaaagaagatgagatgaaaccatgagatcgtagtgaacagaactgagaaaacagatgaattacgagactcaccaggataggcttttcataaaaatcacctgtttctcaatttctgcagtgcgattgtgatcataaatataaagccactccggctctcaaagattgactgtctctcccacaaagcactcgccagacacaaactgagagaaaggcagggatggggaagaacctcgttctgtgagggcacagagagaggaccctgactcagctatggctcccagaaataccagctcctggagtggctgatgttggatagtggagctaagatttcagggttaagcatggtttcatttaggaaaagagggcagaggaatgggaggagattgtccaggcagagggcacagtgtgggccaagtcgccacggcgggaggaaaggagatgcagttgaaaaactcaaagaaccagcactcagggtgagaggggcagggaatataagataaggctggacggttaggctggcctgataccatgaggtcaagggtttcaagcaggaaaaatgccgcactaagatttgctgtgtgaatagaccactctgcctgcagtaggtagggtgtgctggggccatgggaatgttgagtggccagtcagtgagccattgctgtagcctgggagaaggctggagagaagtggatggatgcgggaattctggaggggataaatccacaggacttgacagagtggctatgagggagagggagcgatcaagggtgccacttaagtttccgacctacagagtgtgctagactggatgatacttctttctttcttttcttttcttttccttttcttttcttctttctttctttctttctttctttctttctttctttctttctttctttcttttcttttccttttcttttcctttctctttctttctttctttctttctctttttttggaatccctctaatggttttctataaataggttcttttggtatacctttccacagtacaagtactgatagatttgcttatggaaaatctttagggaatgcactgggcagtgggggaagagggttatcatgaaagatgtgaacaccgaagtgggaggcctcagcaatccagatctcgaagtgtgaggactacttggaactgatggtttgagtaatggcaggagggacatcatcaagatgctcctgatacattgttttataagtgatttaaatgaaagatgagaagcagatggaaaggaagtacaatgtgcagtgtgtctatgtcatgcctgtatttgaacatgatcgttggaaagactgatcaaatgttatagtttagggaccatgcttacccaatgatcattcctttaaacgtaaagcttgaaatttgggaaatgacatttttacaagatggcaaaactggacttgttttgttttctaaggtgattgatatgcccgagcacaaccctggcaatttgggaggaacaatgagactgggaataagaagaactgttttcaaaactgaaaattcaatattaagtaagtttcccatattgtttattttacaagatgttggatgtggctcatgtgactgcaggtgcccagcactctgggtggtggagactccccctgccccttccagcatcctcggagggccctgattctctctcttcccatctcccctgccctcactgaccctctgctctgggcattcttctccctagtaagcttgtcccttgggctggcctcagtagaacacactgaatgcccctccgcatttgatctgcgtgactccctgttcattgggctgttttgtgagttaccgatgctcctggagatgaacttggactgggacttggactgattcacactcagttcttttgaatccacagttctctccattacatttgaaccggttccctgtttaatgtctgtttgcctggtcttagtgactcacaaatgaacttccgagtaggagggcagttatgcacctcagaagcgtatttctctgttccctggcagccccagtgtggggagatggctcgccatttgatatttgctgatctttccactccccataaggttaattctaatttctgtggaactttttcataaattagcatattatataagaataacttattgtttaaaacaaactaaagcctttaattcaatttaataaatgtatcttgagtgcccactctgtgccatgtgcagatataatagtgaccaggacagataccagccctgccctcctagggcctcaaaacaaggggaagaaatgtgacaaaaggggaaggcagattgctaaggggaccggatgcagagagggagctcaggaattgtgagtgttcagtgtcattttcgtgaaattataagaatcccttagaatcctgtgaagttataagaattcttttttttttttttttttgagacagagtctcgctctgtcacccaggctggagtgcagtggcacgatttcggctcactgcaagctccgcctcctgggttgacgtcattctcctgcctcagcctcccgagtagctgggactacaggcgcctaccaccgcgcccggctaattttttgtatttttagtagagatggggtttcacagtgttagccaggatggtcttgatctcctgacctcatgatctgcccgcctcggcctcccaaagtgctgggattacaggcgtgagtcaccacgcccggcaagaattcttcagaaaaatgccttcttaactcaagaaagagtaagaccagaaatatgagcttttcctttaaagatgaatataaaccttctaaggaatagaaagcttcctagccagaatgaaattaaaaaaggaaaggcttcaaagtgaatacagtttcctcctttctctgcataaaaagccattgttctctaagtcactaacatttttccttacacatactatataagaactttttttcttcatgaatgttagcaattctgtagctttcaggtgtcttcagattctatgaaactttgttcaagtaattgcctacgtgacaaaaaatggttggtgaaaaattaatgtcctaaaattatatctattgagaaagattcagtgataattgtactaagtttttaaaaagagcattgtactcaatatagttaaaaatttgatagatataagtctgatttaagatttttcttggccagtcgcactggctcacaccagcactttgggaggctgtggccggcagattgcttgagcccaggaattcaagaccagccttggcaacatggggagaccctgcctctacaaaaaatacaaaaattagcctggcatggtggctcatgcctgtggtcccagccacttgggaggctgaagcgggacgatcacctgagcccaagaggttgaggctgcagtgagccatgatggtgccactgcactccagcctgggtaaaaaagatttgtttttcttagtgctggatgtggtgtaatgtgcctgtagtcccagctgcttgggaggctgaggtgggaggattgcttgagcccaggagtcggagaccagctgggcaacatagtgagactccgtctcaatttaaaaagtaaaatttgtttttcttcacagtagacataaaaatattgatgatttgatgattttcatgaatcttaaacacagcagcaaagcttgttttgaaaaattttgaaaacaactttattgagatataatacatcatataatttgtctattagtagtgtacaattcactgattttattttttattttttatttttttttgagacggagtctggctctgtcgcccaggctggagtgcagtggcgaaatctcggctcactgcaagctccgcctcccaggttcacgccattctcctgcctcagcctcccaagtagctgggactacaggcgcctgccggctatttttttttgtatttttagtagagatggggtttcaccgtgttagccgggatagtcttgatctcctgacctcgtgatctgcccgcctcggcctcccaaagtgctgggattacaggcgtgagccaccgcgcccggcccaattcactgatttttttagtgcattcacagaattgtgcaaccatcaccgcaattttaggatattttcatcacctcctgtagaaaccctgtgcccattagctgtcaccatccctacttcccgccagcccctggcaaccactaatctactttctgtctataggtttgcccattatggacatttcatgtaaatggaaccatatgatttgtggtcttttgtgtctggcttctttctttcttttttctttttttgagatagtctcactctgttgcccaggctggagtgcagtggcatgatctcggctcaccgcaaccttcacctcctgggtttaagcgattctcctgcctcagcctcctgagtagctgggattacaggcacccactaccacgcctggctgatttttgtatttttagtagagacggggtttcgttggccacactggtctcgaactcctgacctcaggtgatctgcccaccttggcctcctgaagtgctgggattacaggcgtgagccaccatgcctggtctgtctcctttcttctagcataatgtttttttgctacatccacattgtagcatgtatcagtacttcattccttttaatggccaaataatattccattgtatggatagaccacattttgtttatccattcctcagctggtggacatttgggttgtttccaggcaacaatttctttaattttttctccttaattttttaaaaagtcctttttctaaagggaaagaaaagtatgttgccttaaatttaagttgtgcttcatagtttccaagaagtatgtgatatatgaacttgtgccctcccacttgtgcagcactgtcttccacaggtctccaaaaaaggctgtgccagagataagaatgtgaccactgtgcaaggctctactgagtggcatacaaatatcaaaacatatagcatgatagtgtttttttgttttcttttgttttttgagacggagtttcactcttgttgcccaggttggagtgcagtggtgtgatctcggctcactgcaacctccgtctcccaggttcaagtgattctcctgcctcagcctcccaagtagctgagattacaggcatgtgccaccacgccctcctaattttgtgtatttttagtagagacggggtttctccatgttggtcaggctggtctcgaacccccaacctcaagtgatctacccgcctcagcctcccaaagtgctgagattgcaggcatgagccgccgtgcctggccgatagtgttttatgaacgtttttttttctcctagtcaacatatttcttttgtagaattttatgtatttatttatgtttttataagctggtacatttcttttgtaggattcccccatcccgtattggcatatttcttttgtagacttttttccaagtcagcacatttttgcaagaatgctatgaacaaaatacatttgcctacattgcctgtgaaaacaattaacaattttgatagaaagcattgaaatgctactcatttttttcatttaaatttgacttataggccagtagttacaatgcttggattaaatagaaaaacaggaaagtaaagagtcctctagtaaaaaataatgccttgaaatagggtcacagcctaaagatattgatagccgcagtggatggatgactagagtgagcctttttttttttttttctctttttgagacagagttttgctcttgtcacccaggctggagtgcagtgacaccatctcggctcactgcaacctccgcctcccaggttcaaccgattctcctgcctcagcctctcgagtagccgagagtacaggcatgcgctactatgcctggctaattttttgtattttatttgatgtggggtttcaccaccttggccaggctagtctggaattcctgacttagggtgatcctcctgcctcggcctcccaaggtgctgggattatgggcgtgagctactgcacccagccgagcctaacttttatattcaagaacaattcctctttttttcttaataacctgttaattccttaagggttatgaaaactatgaattcactttttctgaagtggagattataggtttgaattgatttggacaaaagtactggtaatgattatttgccctacttataagcagtgtgttcctagaagttcccttcctgtgttctatgtgttgtcttcatctgcaaaggccttttcctataaaagggctaatgacagtgtgtgtagaattatcaaagctgattcaagggtccttagaaatgagacattttgaggaagagggagagatttgttaaaggattcaaaataattaccctgatttgatcactatacattatatgtattgaaatatcactatgtgccccataaatatgtataattattgtcaattaaaaaaagaaagaagattttttctaaactgtattatctataatcctgtatctgagtattaactgcatatccatggtcttttccagacttcatcaagattagtttttatgtagtcttttctggtggcatcactttttcctgtatctggtcttcctgtctatgatctgtgcatatagtatttaatcgcgttaaggaggcatattctgctgattcatttcctactgataaaacacttcacatggtttctggcattttgttagaaaaatgctgaatcgaacatcctgacacagtgttttcgttcttttgaatatttccttagtatagatttccaggagttggattattaggtcaaagggtatgaacacttttatgactgataattctgccagactgttggaaagaagggctgagcaaggtcataatgacattcactgtacttgtgtccctgctttccctagtctttttggtaggattatttttcttcttgctgtattaatggaaacaaaaagagccctatttctgttcattgctaaaaagtgaaaacgttttctacttcgaatgttgatttacttgtgtatatagtgcccaggtctgaagtctttattaggacttaactatgggttggtaaactttttcaataaagggccagttagtaaatatttttggctttgtagccattgtggtgtgtaaacagctacaggcaaatatgtgagtgaacgagcacggctgtgtcccagcaaaactttatctatgggcgctgaaagttgattccatatcattttcatgtggcatgaaataatattctttgatttaattttttcaaccaatttaaaatgtaaaaaccattcttagttcaagggccaaacagaaacagtcagggggatcccatgactgtgggctgggccatagtctgttgaattctggtccaaacaagaacctttcagcctgggcaacatagtgagaccctgtctctacaaaaaaatttttaaaaaatcagccaggtgtggtggcatacacctgtagtcccagctactcaggaggctgaggcaggaggattgcttgagcccagggagttgaggctgcagtgagccatgattgtaccaccgcactccagtctgggcaatagagtgagaccctgtctcaaaaaaaaaaaaaaaaacaaaagaaaagaaaaagaaaaagaactgcatgttgaatgaactccacggatgaggcagtgagctgctcccatcctaggcagagttgaaggacatcatctccccacttctctactggcttgcatacatatcctattttatgacagagaataggactaagggggctttcagaagccgtttgatctaacctccttatttttcagctgaggaaatggagggctgagagatgaagtggcacacagttgggagagtcagaaccagggcttggacactcttcccacgttattttctagtcttctaataaaacatgctgtcctggctcccccatctagtgctataatcactctccaaaatgtaactcttggccaggcatggtggctcatgcctgtaatcccagcactttgggaggccaaggcggccagatcacttgaggtcaagggtttgagaccagcctggctatcatggtgaaaccttgtctctactaaaaatacaaaaattagccgggcatggtgtggtgtgtgcctgtagtcccagctacttaagaggctgaggcaggagaatagcttgaacccgggaggcggaggttgcagtgagccgagatcatgccactgcactccagcctaggtgacagagcaagactctgtctcaaaaaaaaaaagaaagaaagaaaaaaaaggtaactcttgaaacacccaattgttagactccttgatgctctaccttcaggtctgtatatttagttgcatgtaaattatacctcgattttttaaaaactcatttttctccttttaaaaaagtttttaattttaaaaaatagagacggggtttctctttgttgcccaggctggtctttaactcctggcctccagcaatcctcctgcctcagcctcccaaagtgctgggattacaggcatgagtcactgtgtctggccttaaaaaagcttatactatctggaaagttagatagtagggcttgtctccttatagtgatgctattagttgattaattaactcattagacgatttttgaaaagcagggagaagtggcacagtgtgggtaagtcttaagtggggtgctttgaaaagtaagaaatgtagaatgaggagtggctaaagatggagggatcaggctcaggtgagaggggagccaggggaacactgaggaactaagttaatagacggttttaagactccaaaaataaactttattgttttgcttgtggctctcaactgagagcacaagagatgggaacataataaagcacaaagaaattcagacaaggttcagagctcattcagggatggccaacaacttgatagtgtctctaaaatattacaagaccctggccttaatttgcttggtcaagtcccagatgtgttgccaagacatccagcgagggaggcaagactttgtgttgaatgtggtttccaaaccaaactgccacctgctagaaagaacatgtttttcagaccatttcagttcacatgtttgaatactgcacaatctggtgtgtgtgaatttagtaggaatgctagccccaaacttatttatttatttctttattttagagacagggtttcactgtgttgtccaggctgaagggcagtggtgtgatcgtagctcgctgcagcctcaacctcctgggcccaagcagtcctcctgcctcagcctcctgagtagttgggactacagccacatgccaccacgcctggctaatttctaatttttttttttttttgagacagagtcttgctctgtcgcccaggctggagtgcagtggcatgatcttggctcactgcaacctccacctcccgggttcaagcaattctcctatctcagccacccgagtagctggagctacaggcgcccgccaccacgcctggctaatttttgtatttttagtagagacgggtttcaccatattggtcaggctggtctcaaacttctgacctcaggtgatccacccgcctcggcctcctgaagtactgagattacaggcatgagccactgtgcctggcctaaaatttttgtagagatgaggtctctttgttgcccaagctgatctgaaactcttggcctcaagagatcctcaatggccttttgtacactttttcaataagggaccagatagtaaatatctttggctttgcagccattgtggtgtgaaagcagctacagacaaatatgtgagtgaatgagcatggttgtgtcccaacagagttttatttatgggtgctgaaagttgatttcatatcattttcacgtggcatgaaatgttattcttcattttgtccagccatcaacctaatttaaagctcccaaattctctatgccctccaaaccagcacccaaacagttagggagcacttacccttagaagcaggggaatgccacaaggtggaagggtgcagagaagacccacaggctcgaggagagagaggagggaagaggtgggccttgagcacggggttgtactgtgggctccctatagggaggtgtatctggtccggttaagaatgcaacacaacacagggccgggcgcggtggctcacacctgtaatcccagcactttgggaggccgaggtgggcggatcacctgaggttgggagtttgagaccagcctgacttacctggagaaaccccatctctactaaaaatacaaaattagccaggcgtggtggcacatgcctgtaatcccagcaactcgggtggctgaggcaagagaattgctggaacccgggaggcagaggttgcagtgagccgagatcacaccactgcactccaacctgggcaacagagcaagactctgtgtcaaaaaaaaaaaaaaaaaaaaatacaacacaacaaacttgaaggaattaggagcccagggcagtgcagtttatacaactggagactaggacctggtgatttccggagttctgtgaagctggccctcatcctcagagcagatgacatgaggacagtgaggtttgatgcaggcagataacagctggcagaggaggccagggagagctcctcaggttgatgccggcaggagcatgacatgactctggcatacaagacacgagtgaagccttctggacctggcaggtggaaatggaatgctttaagaaaaggcttcattcctttcagggaccttctctgcatttcctcgtattaaagaagaagaacttgactaaaacgaccagttctgctttaatgtaagggaaaaagtgttttgtttggaaagaacagaggcacgaggcccattaaaaagatattgagtgagacccagtgctgggagtcccggtacagtttatggcattgcaaatgcagagtggttaagtctaaaatttgaaagagctgaaagaaatggggagaagttttcaggggctagaaaaatggcttttgctttcttgtctcttatcaaagcattgatatggaaaaacagcttctggctcctggtgtgattagattaggaagtttaaaaattaaaaccaaaaccaacattgaatgttcgtgaaacattagagcaggggaaaaaaaagaaaaaccatgtaaaaaaaaaaaatcctcgactgagttaatgaggtaatttacataacagtttaaaagaggtcgcccgggatttagggaccctgagtccatgccatggtaatttgtcattgtgctgagacacaaattccagaggagcacggcagggcttcgtgagagctgcataccacttggcgagcctccccgcctgcccccagagcccaggtccacactgcagggtggctgtcttcttactgcttcttgccttttactggggaaaccattcgctaaagcgtgtttgttaatatggaggttcataggtctgggacatagcacctttcatcctaacaacagatggcattcctgccccctctctagacaagcacttgtcctcatcacttcaccgaagggaactagtggagtggttaagagcccagcctgtggagccactgctcaccagaggcccgttgggcctcagctctcagtctctggctatgtggagctacttacccgcaccacgcctcagtttctgcatctgaaagacagagataagagcgccgcctcatggggttcttgtgagggttaaataaatgatatgcgggagcccttagaacagtgcctggcacagaaaaggcactgtttaagtgtggctgatatttgagagcattgacctgtgatcttctcaaagcttggggcaaacgtcggttagtgacctggcattaagaatgaggtcccactaggggagtgggagggaagaataggctttcccttgctcttgcaaggttatttctattctgtctttcttggctgctagctccccacttgccaatgcataagatctaagaaaagagatgccaagaatgaggtaagaatactaaatggaaaacaaatgaaagtgatgaaaggtggggtgtggtggcttacgtctgtaatcccagcactttgggaggccgaggtgggtgaatcacttgaggtcaggactttgagaccagcctggccaacatggagaaaccccgtctctactaaaactacaaaaattagccaggcgtgatggtgcatgcctgtaatcccagctacttgagagactgagtcaggagaatcacttgaacccaggaagtggaggttgcagtgagccgagatcacaccactgcactccagcctgggcgacagagtgagactccgttttaaaaaacaaaacaaaaagaacaaaaaaagtgatgaaaaagaatgtaatgctataatatagagttaaaagcaaagacgcatttttcaactcagatgtattatactaaaaaattgagataaaagcagattaggaagataaaattagggaagggggaggagtttagatactaaaagaaatgaaatattttataaaaattggagaaatgacattctaaaattcaaaagtaagaaataaaggagaaatataggagaaagtaaaggagaaataaaggagccagctgtggctggctgcaactcggtgctttctgcacaccagtaattaagacattgctctcatcacccctaggacccagccaccattttgcacaaaagaaaggaatcttagcaaagttaagtcactcatccaggtcacttgttagaaagtcattgagctgactctttgaccacctcactgtaccaaacggctggaccttaatcaaagaagaggcagaaaaacccaaacagctcccagagctggatgctgccctcactgagaatcctgagaaaaggttttgcaggtttcgggggtgtctggtgggtggagagcagggggtgcagaaagcgaagaccctaccccaggcctcttctgaaagccagtctgaaaccgcgggtttagcttaaggatagacacaagcactgagtcagttttgcactgagcatctaggccagtagggcatgcagacaggcaggtgtgagaaatgccacagcttaagctcaacaatcagcagcagctacactgagccttagagttagagaggcagtaaggagtggtagggactgtggcaaatcagcaagcatgtgccccatcaaagaagtgacttccacagctggtagttgtatcaagaactgtggattcactgctgccagtcttctaaattttcaagaaaatctggaaatctggagttttatgtaaaatctcctgacgtttaaatgttggcaacttatttacatttttaaaatattgtgtgtttgccagcactctgcaagcgaaatacaacaaatatctgcaccctgggcagcctcttaggatctttgaattagataagcactgaattagataagcatcagcaaattcttgcacatacgagagggctctggtccttaaaatgcctaattagcagaaggcatggttgcaggtagtcttaaaagtgaagtaaattaagacactggtgcaaaaaggacatttgtgtaaaagcaaggcaattctaccaagaaaagaggtaatgaagcccagcaggtagtggttttacttttttattaagttggtgcaaaagtaattgcggtttttgccgtcgaaaataatggcaaaaactgcagttacttttgtaccaatgtattagatgctatgggtgattgcctttagccccctggaaataggagatatggcaccgggggaaagataaggatcagaaggtatagaatgggagtggacagctatgtgggtgatagcttccaggggagcgaatgtgggagaagaaaagagggtacagtcttgggcaggggtccccagttgaggatgatgaacaggtagatggggcaaaaagtgcctggaggagcagaggtcacagaaggggaagggtggcagctgaagacagacctgctggattttagagagcagttctgtaaagtcacaggaacaaaagccaggttgcaaagggtgggagtgggaggtttgaataaagggtgagtcagagcaagagggcatcatggacaagagtggggctggatgatttttgttttttattttaaaaatttttaattgtggtaaaatatacataacataaaatgtaccatcttaaccatttcctagtgtacagttcaattgtgttaagtacattgcattgttgtacagtctccagaactcttctcatcttgcaaaactagaaactatacccattaaatagcaactcccccttcccctggcccctggcaaccaccattctattttctttctttcttttttttgagacagagtctcactttgttgcccagattggagtgcagtggcatgatcttggctcagtgcaacctctgcctccaggttcaagcgattctcctgcctcagcctcctgagtagctgggattacaggtgtccaccaccacgcccagctaatttttgtatatttagtagagatggagtttcaccatgttggccagcctggtctcgatctcctgacctcaagtgatctgccccccttggtctcccaaagtgctgggattacaggcatgagccaccatgcctggcctctattttctgcctctttgggtttgactactctagatgatatggacaggagaccgggaaatactgggcagaagagggcgattctctggcaaaggcccgaccctcaagcctggaaacctgtggccctaaataagaacaagcattcctgttttcacccccaaatgttgccttttggcccgccatgccccctatcctgtactatataaaccccaaaccccaggctccatgagcagaagagtggtgtggcagagaaggagagaagagaaggagcatctgaacatggagaggagtccggctggggaccattggagaggagattggctgctggacggccaaactccaggggaagatcatcttcccactccatctccttcctccccatccatcccactgagagccacctccaccactcaataaaatccccgcattcaccatccttcaagcccatgtgtgacctgattctttctgaattccggacaagaacccaggcaccaagaaggcactgagctggttaacacttaagccatctatggacggcagagctaaaagagcactgtagcaagcccagtggagtttccggagtcacaggcacccactcctagacactactgtgtggctggagcccaaaagtgttcgccctggatcctgcacctgcccgtctgtgtgctccccctcccataagggatttgagtgcacacagtggctgaacagatgagccatacctctgttgcacgtcctgtgaggggggtcagggaactctctcgttttatcgatacctccttgaagtagaatcatacagtatttgtccttttatgagtggcttatttcacttaacatattgtcctcaaggttcatccatattgtagcatgggacaggatttccttcctttcgaatgcagaataatattccattgtgtggatggatatgcacattttgtttatccattcatccctcagtgaacatttgggttgcttccaccttttaacttgtgtagcttttttggggggatattttggctctcaaaaggacaaaggaaaaaattaggttcagttgctaggattactcacatgagggtaggcatgggcaggaccattaaacaggtaaaaatatattatgtatgaggcagtatcttacccagtagcaaattagagaaagagatggtataatttggaaaggtggtttttgtttctgataacccttttatccacatttttggtgtctttctgcctgcattgggagtgctttataggtcctaagacttttgttggttttctttctctaaagctttgctgacatttacttcttaagtgaacattttattttgtctctaaaaagactaggacagaaagaaagactgagtcactttgttgttgagattttcccccattcctaggatcatttcatggcacctgtgacagaggactgctcttaggaacgtggtgtgtatacctctcagtttctgactctactcctagattttacattcaacagtatctagcattttgccttgtcgtggaatgttcttatactgcactttcaatgttggtgtagattagttgattctaaccagaaatgcatgtcagggtgacttgtggtgcatttttaaaacccacgtggccagacactctcctgagagtaatcaaatcagaatcgatggtactggggtacccgggctccagaatgagtattcttagttttattttgttttcgggatgttctcaaatagaatttcattggtagcattctgaactgattctcaacatagagtttttaaggaaattttaatttttcctttttcacaggtatagcaatggattaattttgtaaattcatttctgatagatttgtaagcaatgaagaaagattttgaatgcataaaatagaatttccaaagttctgaaaacatgtttcattgtatatcgtatctgttgtatgttgatttcattcaacaattcattattgagtacctgcttatctgctaggtgctggtcttaagaattgaggggatgggccaggcgcggtggctcacgcctgtaatcctaaggcgggtggatcacgaggtcaggagatagagaccatcctggctaacacggtgaaaccccgtctctactaaaaatacaaaaaattagccaggcatggtggcacacacctgtagtcccagctactcgggaggctgaggcaggagaattgcttgaacccgggaggcggaggttgcagtgagctgagattgcaccattgcactccagcctggcgacggagtgagactccgtctcagaaaaaaaaaaaaaaaaaaaaaaaaaaaaaaaagaattgaggggatgactgctgggtatatacccgaaaggaaggaagtcagtatatcaaagagatatcgcagtcccatgtttattgcagcaccagtcacagtagccaagatttagaagcgacctaagtgtccatcaacagatgaatggataaagaaaatgtacttatacacaatggagtactattcagccatagcaaagaatgagatcctgtcatttgcacagcacagatggaactggagatcattatgttaagtgaaacaagccaggcacagaaagacaaacatcgcatgttctcacttatttgtgggatctaaaaaccaaaacaattgaacccatggagatagcagaaggatggttgccaggggctgggaagggtagtggggggctggtagggaggtggggattgttaatgggttcaaaaagtagaaagaatgaataagacctactatttgatagcacaacagggtgactatagtcagtaataatttaattgtacatttaaaaataactctaagagagagtaattggattgtttgtaactgaaaggataaatgcttgaggagatggataccccattcaccatcatgtgattattacacattgtatgcctgtatcaaaacatctcatgtaccccctaaatatatatacctactgtatacccacaaaaatttaaaataaaagatttaaaaaaataattgaagggtcaggtccctattttgtctgttacctcgtatagcttatgttctagttccattcatttggattttattgtctggagataacaatatcaatcactgaaatggttcgctttctgttctcagtgcttcccatattttgatttatttaatccttacaactctatgaagtaggaactatcataatccctattttatagatgaggaaactgaggtagagaggttaaataatatgcccaagccacacatccgttaaatagtacagtggaatttaaagccaggaagtctgacttcagagtcactacactcccctacccctttctgtcacctctgagatatcttagcaaatacagagtctgccttaagccaggcagcagtcagaaaccatgcagtttcaaacattctcatgatatcctgctagtccccttgactcgaagatacgattccttatatcctaatttggagatttgtgccattttccccatcatctcgagaaatgttggcagactctagtattggatttacaaatcacctattgtaatgaagggaacagaaaagaaattttggactataggaggaaaagatcaatgtcaaagtcagaggtcataggacacttaggatcctctgaggcaacttcctgatgcttctatgttttctttctttttctttttctttctttttttttttttgagacagcatctcgctctgtcaccaaggttggcaggttggagtgcagtggtgacatcctggcttactgcaacctccgccttccaggttcaagtgattctcgtgccccagcctcctgagtagctgggattacaggtgcgcaccaccacgctgggctaatttttgtttagtagagatggggtttcaccatgttggccaggctggtcttgaactcctgaccttaagtgatcctccccctctcagcttcccaaagtgctgggattacaggtgtgagccaccgcgcccggccttcctgatgcgtctgtgttttctaactgtatgttattgtgctttatttcccatttttattttaatttttatgaagcagttgttttagtttaggctgtcctgaatgacccctgccagtggtatgttcgcattctctcaaaggaactccctgcccccactattccccttttttctaaaatacataccttaaatattcactatcattcatatcgtcaccagggagctcagtctatatggacagaattgcaaatagaagttcagctgtgatcattgatcgtacaaagttatatgagaatacaacccatttgtgtttgcttgatccaagtcaaaagctcaaacaagatgcaaagaaagcatttatttggtttttcttggttgaaacatcctgttccagcctcatgatgtctttgagagtctgataattccctgcctgttgaactgagcatggcttctgattctgttggagtttcagcatgacttccagcactgttatcttcttaacccttggctgtgtacctgggatctgcgttttgagggctagtgctgtaggaagagtctctggtcctctcagactgctccagtgctggagcccacttggtccctggaccatcctgcttctccacatgctccagtaggggcattctttttattattattattattattattattattatactttaagttctagggtacatgtgcacaatgtgcaggtttgttacataggtatacatgtgccatgttggtgtgctgcacccatcaactcatcatttacattaggtattctcctaatgctatccctcccccaaccccctaccccccgacaagccccggtgtgtgatgttcccaatgggagcattcttgagaggtgtttggtgatggatccgactcctattcacctgacaatgaagtcactaggcagctcgttgatcgccgtgcccatcgccacactggtcatgcccagggtgctgtgcttagctgcagtgcctcagctacgtaggcatgtttaggcagctccccagatgattctcagccacacacccctggttaagagctgttggcatagatgtgctatcatttaatccaccagtttgtctattcttgatgctcagcttgcttccaattatttgctattaaataattcagcagtgcacatctttgtggttaagtctttgtcctcatttctattttctgggataaattctgagaagtccaactgtaggatcataggataggtacatttttaaggtggagtacattttgaatgtggccagtacggtgtgaaaatctggaggcagctggtggagtggagaaagcattgggccaggtgtgaggaagcctgggatcaagaacaggctccgctgcccagcaaggcagggctttgggcaagtctcttccctgcccccagttttgttttcttcctttgtaaatgaggctcattacaaatctgcactgaagcgatagtgcagacatggccgtctcttagtcctgcaggcaggtgtatataaggagggcagatctgctggattctgtggtggacttgtgtagcatctggcttccttttatgcaatggtgatggcttacttgagaagtgcttcaggttttcaaagaagctatcgccatcttctattagaaaagaagaaaatctagatgactatatggagtctattagttcatttttagtcctctgatagatagatagtgatccaggcacttgcctccacaaagcatcatggatgtgcttgtgaagctgcttactctaatattaatctcgctcttgtatctttacagggaaactttatggtgatgttccttttatagaagaaagacacagacatcggttcgaggtacggctttcatgctgaattactggggaatatggatgcttagtgtgaggaacccagtgattacaagctgagcctctggaaaaggtgtctagcctggtggtattcacagggctcagagaggaccaaatttcccacagtctcccacttccagaggagatgggcggcgaggggacaggggtggggagtggggggcggaggctctcatgtttttggctttccaaaggcaaaatctttatgtacctgcacatggggcctatcaatgccctttgttactctaactgccatcttctagatcatgataaggccatcatttcttatccttagcccccaccctttattttgccaattttgtggaaaagaggacttgaatcttctgagaaggaaccaagtgccttttgggatgggggtgcatccctgggtatcagggggtgattagtttgagaacctctttggaaatttacattaagcttgaggcttagcgtcacatgactaaaaggagttaattgttgaggttgccacatgagaaacatagatttctcgaaatgtagatcgtctatgccaggattaatgagtgtgtcaattacgatgcatttgactgtgaagaacagaaatccctgcttgttgtcactcaaatcaccctaaacattaaggaaatttgttatctcaggcaccaggttgtccagaggctggacaggctccaggcatggcacaaccagggctcctgttgtctctgtggttatctcagccctacccttgtctgtgtgtctgcttcgtcctttagctggtctcccatatagttcccaggtggctgccagcagcatctgggacaagaggcatctctccagacagggaaatcaacttagattacctgcccacctgtgaactagtagccatttttcagggcaatgctgaacatcagtgggcttaaacctgggttcttgcaatattcatcttccaagagggctgggtttattatgtttggcttagaccagttagaaccagtttctggaatgggacagatggagtttcctggttcatataggggtggagtggataccaggacaagcctagggctctgttttgaaggaggactcgtgggaatcaatgccaagtaggcaatgaacagtgtcactatgaccaaggaacataatttggtacatgtaggacatttttggtcttatttccattgggaacgggcccaactggtgggataaaaattattgagctgctttggctaagtggcaatgagaaggtgcaagaactggtacgtacgcaatagcgtagccattcattcattcacacctattttgcatctggtatgcattggagatggaaaggggaaagacagacatggtctccctcttgttagggagcttacattctaatggagaggacaaaaaataagataacataataattacagattaaatcctgtattggataagggacttgtatctaaaatatatgaagagctcttacaactcaataatgaataattgcaaatgatatgaatagatatttcttcaaagaagatgtacaaatgactaataagcacatgaaaagatgcccaacaatcattagtgatcagggaaatgcgtattgaaaccacaaaaagataccacttcacacccactaagctggctataatcaagcacagacaataataacaagtagtggagaggatgtggggtaactggaaccttcatgcattgctggttggaatggaatatattgcagcccctttggaaaaccatctggaagtttttcaaaaagttagacataagaattaccatatgacccagcagttccactcctagatatatacccaagagaaatgaaaatgtatgtccacacaaaaacttttatctgaatgatcatagcagtaatattcataacagccaaaaaggcagaaacaactcaaatgtctaccaactggcgaatagataagcaaaatgtggtgtattcattcaatggagtattattcagtcatagaaggaaatgaagtactgatttatgctacaacatagataaaccttgaaaacatcatgctgagtgaaagaagccagatacagaagcccacatattgcatgattctattaatataaaatgaccagaataggcaaagctatagatgtgggatatagattagtgattgccaggggatcgggtcagggtgatggggggttgggggatgaggttaaagggtacagggtttgtttttcagttggttgtggtaatggttgtacacctctgaatatacgaaaaatcatttgtgtatttcaaatgggtgaattgtatggtatgtgaattatgtcttaaagctgttaaggaaggaaaaataatgacaatacgagaactggtataattttaaaatgtagaataaaagctctgaggttaagattgcaaagaataggtgagactccaccttaacttttgacagggaagcactttcactgaaggagaggctgaaaaggagtccttaggtttgggaaagggctaaggtgagatgggggccagaaagggccacaagccaggtcatcaagttgccatctattaggatattttagtagaaaacttgctccaagcttctctttagagcttttatgtaactgcatgtaaagaaagcattggggttagtcacaagggaaataggatagttttaatcttcaagcaaatttgtgattcggggagagatagggaagtacacataactcaagggaagaagcaaacatggaaatggctataaataactagtctcaaggttccaggtcagaatgtctgggttacagggcctactttttgaatctcacctttgggtaatagaaggcacctcctagatttaggtgctgtggttacattttatatctgaggttcatcattagtttaaaattggctttgagcattgaatatagacattaactactagttagaggatcactgaaatggaaaacccacccaactgatgaaggacctggtatggcagctggtattgcactgtggcccataaacacttaatttcttgttttgcaggtaaaccctaacctgatcaaacaatttgagcagaatgacttaagttttgtaggtcaggatgttgatggagacaggatggaaatcattgaactggcaagtaagtgggctcttcatttttgaaaaccttccaataacttgcctttttgtggaccacagactaatttgagacccagttttttttgcattctttcttttcttctctcctttgaaacaaatatgtaactacaaagtacatgaaaaaaacagactgctggctgggcatggtggctcacgcctgtaatcccagcactttgggaggctgaggttggcgaatcacctgaggtcaggagttcgagaccaggttggccaacatggtgaaaccccatctctactaaaaatacaaaaattagccaggtgtggtggcgtgcacctgtagtcccagctactcaggagactgaggcaggagagtcgcttgaacccaggatgtggaggttgcagtgagccgagatcgcgtcactgcactccagcctgggtgacagagtgagactttgtctcagaaaaacagactgcttataatcctgatcattttggagcctattagtctgactccaccataaaatgatgtattattccaagtctaccagttctacaagtagtatgcttccttaccaactcctctctttctgaggctacttctttgtgccagcctctaggttaggtgctctgggaaaggcagagtggcactgttgagtggcaccctgcctgctctcctcttttgagaaagaatagccaagtgccacctcatttttggtgactgatgttgatttctgttgcttgagggacctggctcctctcctgcctttctccactgtgctgggtggtcaagcacgggtcagtcatttaacttctgaacactaatcactgcccccagagttgtttttaagagcaaacagaacagaaataaaggcatcagaattgaggaagaacaccgaagttgttgttagtaaccaggctggaacacccgtgagcacataggcacaaactacacatttactattgatgagacagaaggcagtgttcttctcagtcagctttgcaaggacatggtaagctcatggtcacagctggtctcagctctttgtcttgatgttctagcccaggggttggcaaactactgcctgtgcaccacgtccagcctgctgtttacagccagcttatgagctgagaatgatttttacattttttaatggttaaaaaaatttaaaaaagaatactgtctgtgacatgtgaaaagtgtatgccattcaaatttgcatccataaataaagttttattggaacacagtttaggggtagaaaggtgttatctgtgaccttcttacccatcataagggtcatgaccaacaaccctataacaagacaggttgacaagagaaaagcataacaaatttatttaatcaaagttttatgtgacactttagtcttcaggaatgaagacccaaagacttggggaaaacttcatttgtatgcttaggtttgatgaacagtggacagccatgtagcaatgtgattgggcaaaagggcatactctaatggtaatagactgacagggaaacccagaaaggcctgtctgctcagattcttcttggcctttctgtgtagcatcccattcccccaggtctagagcaggactcatctggaatgagggtcttatgacctactttcaggaaaggtaggtcagataatttatttatagccagctttcacatggaaaggcgggggaaacatcacagtgaccttcttgctttggaggtcttcccagtcaccttcagttcaaactactttagggtagtattttctgagctccgacaacagcaacactcattcatttatgtcttgtctatggctgcttttaatttttattttttttgagacagggtctagctctgtcacccaggctggagtgcagtgccatgatcatggcttactgcagccttgacctcttgggcacaagtaatcctcccacctcagcctcccaaggagctgggactgcaggtgtgcatcaccctgcctggctactttttttttttcttgagatgaagtcttactctgttgcccaagctggagtgcagtggcgcgatcttggctcactgtaaccaccacctctcaggttcaagcaattctcctgcctcaccctcccgagtagctgggactacaggcatgttccaccatgcccggctaatttttgtattttttagtagagatggggtttcactatgttggccaggctggtcttgaactcctgacctcgtgatccgcctgccttggcctcccaaagtgctgggattacaggcatgagccacgacgcgcagccaattttaaaattttttttgtagcggcaggtttttgccatgttgctcaggctggtctcacctgggctcaaggcctcttccttcctcagcctcccaaagtgctgggattacaggcatgagccaccatgcgcagccaatttttaaattttttttgtagcggcagggttttgccatgttgctcaggctggtctcacctgggctcaaggcctcttccctccttagcctcccaaagtgctgagattacaggcatgagcaactgcacctggcccatggctgttttttatgctaccatggcagagatgagtagttaagaaagagaccttatggctcacaaagcctgaaatatttaccttttatagaatattggccctttacagaaacatttgctaactcctgggctagactcacacatatacacttcatttaactaacttgaatttaacattttcacgtgcctccttgacctgtttgtgtatttggatgttgtgttgccacttccatctcaacttatttaaaactaaatttacatggtctcccaattagttcattctcctgtttctgttaagatatcatcaatatccttgtccagggtttctcagccttgccactattgattgacatttggagtggaataattctttgtcgtggaggctgtcctgtgcactgtatagcaagcttgtccaacccacagtccgtgggctgcatgcagcccagggtggatttgaatgtggcccaacacaatttcgtaaactttcttaaaacattatgagatttttttgcaatttttttttaagctcatcagctatcattagtgttagtgtattttatgtatggtccaagacaattcatcttcttccagtgtggcccagggaagccaaaagattggacacccctgttgtagagtgtttggcagcattcctagcctctactcactgccactatcatccctacctcccacgttgtgacaacccaaaatatctccagacatcatcaaatgcccctggagagccaggtgcagtggctcacgcctgtaatcccaacgctttgggaggcgaaggtcggaagatcacttgaagccagaagttcgagaccagcgtgggcaacatagtgagatcctgtctctacaaaaaactaaataattagctgggcatggtggttcgtgcctgtggtcccagctacttaggaggctgaggtaggaggttgagcctgggaagttgaggctgcagtgagccatgatcatgccactgcacttcagcctgggtgacagaacaagaccctatcttaaaaaaaaaaaggcaagtccctggggggcacatttggtggagaaccattctcctagactatcaggctagaaatttcacatattagctcttcttccccttcagatcccaactagcagtgtgttgtcaagtcctgcagattctgcctctggaaagaaagctggtgtttagaattgcactgccatccctagaacactagtcccagtgcatgccaactccagctcacacttgtcctcaatctccttcctgcttccaagccatcccttctccaatacctcctaacaagaacagaactctgcagtgtgtgacactaatttgttggataaaccactctcatatattgagtactaagggtgtgcaggatactgtaaaaatggtaccgtgatgttccagaacctgcatttccagcctatatgctttaggctccagataaattggattgcctgtgcgtcttctaacctccctcttctttctccgtcttagctcatatcactattctccatttcaaatgccttttctctgtctcttttcctttttgtctctaatctgttcaagtacttccagagtcccgagcagaggggagaattgaagtccaagaaggctcctttgaacgttgtagcattttacctagacctgaaagaaggaaagcaatggacattcagtgtgcacttactggatgcttgtcactagacctcttgctagggactttgcataccttatgtaactaacaaagcagatgatgctattcccactttacagaggacaccggagtgcaaagaggttaaatgacatgcccagggccatccagctagtcctttgcagcaagagcaaacccagttggttacctccttctgccaccactgctgtgggatttcattgtttctcttgttttcacgttctacctaagatgatcaattcatgcctagagttttgaattagaatagtaagtacgcatttccaggagtctttctgatggaaatgcccatcatttagaattaaagtgtggatcgctgttggtattgaagcctcttaaatcttcctagcatgtgagaaggcagaaaatttcttaagcaaattactatttgtttactttgtttaagtacttattcacttttaattcttctggttgtcattattgtcatcaaatacttagaaggttctttcatcataaggatttagattcccactggggctttcaaatttcatgtggattgaaaaggaaatgagagctgctataaaaccttgcagtttttaaaagcggactgcaagcagttattaaggaaaattccccagaagattttgatcttagataccccttggaaacatatccacgaatctccactgttcctgaagggttctgagaggaacaacaaagcttgagattaatattatataatgtcagaatttggtttaaagcaatcaacagcattattttaaagataattttatctaactgatagaacatcatcaaaataaaaactttttactttctcctcatattggcatagaggattttttggataaagtgattcagagcaatgatccattcattcacatagtctgtccctggctattacatgattacattgctcagcatctgtctgtagtgatacaaaagcacagttactgtctgcttttttttcaaagatgtccctagatgttatgcagtaagatttattgtctcttaaattttaagctacattgcttaatttcttctctaagtgcggatgatttctctgcgtttcttgagggaatacattcctgggagaaggtggcattccccttatcaggctttcttacctgcatattcctctaattcaaggaggtttcttcttagatgtagaggatttctacactggatttttctgggatcagagctgtcctatagaactcactggatttttctgggatcagagctgtcctatagaactcactgcaatgatagaactagtccaccctatccaatatggtagccactagccacatgtaactttgaacatgtttcaaatgctgaattaatgttaatgaatttaagtagctacatatggctagtggctaccattttctatagcagagctttttttttttttttttaataatttcaactttcattttggatgcagggagtacatgcgcagttttttttgtttgtttgtttttgtttttgagatagggtctcaccctgtcacccaggctggagtgcagtggtattatcatggctcatggcaacctccacctcctgggctgaagcgatcctcccatctcagcctcccaagtagctggaaccacaggtgcacgccaccacgcccagctaatttttgtattttttgtacagacagggtttcaccatattgccccggctggtctcgagctcctaggctcaagaaatctgcccaccttggcctcccagagtgctgggattacaggcatgagttactgtgcttggcccacgtgcagatttgttacatggttatattgtgtgatgctaaggtttagggtatggatcccatcacccaagtactgactagagtacccaacagatagtttttcaactcttgcactcccctttccttcctccctctggtagttcccagtgtctattgttcccatctttatgtccataagtacccaatgtttagctcccatttataagtgagaacatgcagtatttggttttctgtttccgtgttaattcgtttagaataatggcccccagctgcatccatgttgctgcaaaggacatggtttcgtttttatggctgcatactattccatggtatatatgtgccacattttctttatccattccaccattgataggcatctagttgattccatggctttgctattgtgaatactgctgccatgaacatgtaagtgcatgtgtcttttttgtagaatgatttattttcctttgggtatatacccagtaatgggattactgagttgaatggtaattctggtttaagttctttgagaaatctccaaactgctttccacagtggctgaaataacttacattcccaccaacagtatgttttcttttctccacagccttgccagcatctgctgttttttgacttttttaataatagctgttctagcagggctttaaatgattaccttaagaaagtagacatttgcattcaatcatcatttccttattactgtagtagtagctttggatctttgctggtaagtgatgggaatttgtgattttgaattccatactagattttagatcatttgataaagcacctcattgaaagctttaaagttatatttacttccccctcttaaacttattatattttattatctttagtttgagtcatagccagggacaggatatttgaatgaatggatcattgctctgaatcactttgttcaaaaaatgctcagttttgtggtgctatgagtaatacccaacttaaagctgtgactagaaaagcaattgtcctcgttgggttcccaagggtagcccaatgggttgatattgtgctggtttatcccaggggacacttaccctgggaaaggagaagaccttgcaggaaatggcctgaagccacctaaagaaagaaagacccagggttagcctaaagtccaagggaaattgaaccaacataaatctacaaagtgccttcaaaaagcaggcagatttggggaaagtggaattcttcttgccattcaaaaatttttgcttgactttgctcactctgacaccttccgcacataaaatttccaagatgtgttttacaatttgaaattccacgaaggaatggatggatagtgaaagtaactggctgtaatgataacaggttaaagaatcatcttaccatttaatgagttttcatattcaaagataagaagatctttaaagcagttctcctgtttgtctgctttaatcgcatcgtgattgttctcatttcagatcatccttattttgttggtgtccagttccatcctgagttttcttctaggccgatgaagccttcccctccgtatctggggctgttacttgcagcaactgggaacctgaatgcctacttgcaacagggttgcaaactgtcttccaggtaaccagcttactgctcttagcaataaaccaagatgcatagttattaatatcttagggtttcttacaaaaattaataccactatagaatttttaaatgtgaagaatcagtttttttctcttaaacataattttcttctctttgtgaaaatgatttaatcacacctacggtagtaatgtgtcagctttccaaatcgtgatgacactgggtattattttagaaatttttttcattttgataagtgaaaagattgtcttttgttgattctttgattaatatatatgaatttttatatgtttattggctgtttgttttatgaatagtttgttcatatcttttcttcattttggtattgtattattttccttactgattggtaagctctttatgtataaaggtcattaatcctttgttaggctgcaaatatttttcaaagtgattttgctttccttctaaattgttaatggtagttttgttctccctaaagagtttagtccttttttatgttttttaaaaatgtatgtagtcaaatattttacttttgtggcttctgcctttactctcatgcctaacatctttccttatggaaagattatataaataataacccctgtgttttcctctagcatttttctggtttcaatttcatagtttaaatctataatctatatggattttattttcagtgaaacctgtgaggttgggatttggctccctacttccctgccaaattgtcaacgagttgagtaatttgactttgtttcagggatttctattttgttccattgatgattttatctcttacacctgaacctttgccatccttttcattttcatagcattattataaatcaggaccttatcgatcctactcccaccattattaacatgtttagtgtgttttgctattcctccaggcaaactgttatttatttattattttcttagagataaggtctggctctgtcacccaggctggagtgcagtagcacaatcatagctcactgcagccttgaactcctaggctcaagaaatcctcctgcctcagtctcccaattagctgggactacaggcacacaccaccatgcctggctaatttttttaatttattatttttgtagagacaaggtctcactatattgtccaggctggtcttgaattcttgacctcaagcaatcctcctgccttgacctcccaaagtgctggcattataggtatgagccactgtgcccagcctgtacaatgctttttaaaaatcaagtttgaataaaaaattccttagggattttaaaattaaattaaattaaattaatttatttatttatttagggacagggtcttgctctgttgctcaggctggagtgcagtggagcaatctcagctcactgcaacctccacctcccaggttcaagagattctcctgcctcagcctcccaagtagccgggactacaggtgtgtgccaccatgcctggctaatttttgtattttttagtagagacagggtttcaccatgttggccaggctggtctcgaactcctgaccttaaagtgatttgcttgctttggcctcccaaagtgctgggattgtaggcgtgagcctccgtgtcccgccaaaatttcattacatttcaatactagtttggggagagtttatttttctttcttctcatccaaggatatcgtacctaataacttgaaaagcagaagcaaccatccagaatatcatagactttggtaggggttattaccacaataaccagatatatgttgttcagaagattaccactgccaaccctcattctggcaaacaaccctcgcagtgttgctgttgagggctggcaggatctgtgtgtggtgtgcacgtgtgtgcttgttacacaaccctacttatttgtgtcattacctgctaggagaagctcacagctctctagcatttcctttcaccatgtgttcatatgggaacagcttcacataatttgcactttgggcatcttactgtattgatgttcacccctttcagtgcactgactttcaaactgtgctctcggagctggagtctgggctgctgcgggagcaggccatgggggctctgggctccttcctgcttcagctgagcagctccactttatctggctcatgtgccatggttctgcaagagagatttcatctgaagaagagcttcctgtgttctgagactgcacagcttatgccactgattggacatcctaatgtggtcccatgtcagatgtgggctgtgaccctttgcagccgttttacaattcccgttattttagattctcacactgaaaggaaggtgatagtgggacaagttagatggctgggagaaataactcacttataactatctggctgtttgcaaataccaactaatatacaaatcctgtctggctcgtgtggactgcccacctgtgtgttgtatggcctgccaattcccgcatggcgggtggtggtctctgggtagagcttccagcggggtgtggtggctcacgcctgtaatcccagcattttgggaggccgaggtgggcagatcacctgaggtcaggagttcgagaccagcctggcgaacatggtgaaaccccgtatctactaaatgtacaaaaattagccagacgtggtggcacacgctgctgctagggaggctgaggcaggaggagcgtttgaacccgggaggcagaggttgcagtgagctgagattgcaccactgcactccagcttgggcgacagagggagaccctgtctcaaaaaaaaaaaaggcttcctagtagtttctgaaaaaactgactgattgctagtgactcctgagtgagatatagtatgtctcagagagaaggaaagacctcttaaccaagctctgatgctggcattggaattatagctgactagtaggcttccatgacactgagggaattcctacgtgtatcaaccacaaattggtacattccttaaggacagccagcatcttatttatctttatctccctggctcccttacacacaggggttgtttattacccattaaagtaatgaatgcaggtagcaggggagtcaaatcttgacacatttcagagagttttctgacagagggtggtgactatgaattaatccagtgacagacaccaggattccagaggaaccttgcacttcaactcctctctgcccagctccatgagattagtgagctttgaaaagcaaatgactactctgatgccaggctctaatgtgagctgagttggggctgtatttctgacaaacaagattactgcttgtaatcaaccctaaacaatgtgacaaggaatatgaacactagaataatgacttcctttcccagaagttggcgctgatgatattcaattgtatggcacgtgtacggccaatgtctttaaagcatggagtgtaaaaatccttgcctttgagttaagcgtacctgaggtgtaacctccgcattctgcctagcggagaatatttatcttttagggcctgggaagttgcagtaagactattattttgggatttacagctagtgagctaaattctcagctacttcattatctacagaatggcagcagttaggaagaccaatttcacctggttttaggcttgtagtgggcagttcaagggcacaatagcttcaggacagtattttttaggtttttatgagctatttaaaaatacatgcaaaatcaaaataagagtcttgtttagggggtccccccaagactgcccacactttggtgatttgctgaaagtaatcagaatatagctgtactcatagctaatatttatttatttatttatttagagatggagtttcactcttgttgcccaggctggagtgcaatcatgtggtcttggctcactgcaacctccacctcccgggttcaagcaattcttatgcctcagcctcccgagtagctgggattacaggcacccgccaccatgcccagctaatttttgtatttttagtagagatggggtttcaccatgttggccaagctgggcttgaactcctgacctctggtgatccgtgtgcctcgggctcccaaagtgctgggattacaggtgtgagccaccgcgaccggccttatagctaatatttattatggtggcaaagtaaacatgcacagcaagatcagtaatgggaaagataagtggagtctggagaaattcatttgcacgtttcctatgatctctctcctgtgataagtcacgtcgagttcgccttccttccagcagtgaaaatgcaactatgcctatgtgatgtttctgcccagatgagccagtttgaggctcagagtttagggatatttcgagggctggtcacataggcattttctacctagcaaccaccaaaattccagatgccagagggaaagcaggtgttcaccatagatcacattgtataaacagcctaagcccagcaaaatgaccttatcagttagtaatggagcacacattccgaaagccatgttcccggacaccagccaagaactaaccctgcaagcaggccctttgaaagatagcagcctcaagcctgctgttaactctttttttacacgagtctaactaacaaaccattttgaaaataaaaaaatcaaatgggaaataatggtccattaaataaatcattgcaattctttgctgatctctctcctctggtgtctaaacaatttgtctcacgtataaaaggcaaccacaaatttgcatggtcttgctgacacataatgtaaaagaatgagactgcttcatgtaattataagaaatacatttcaggagaatatgaaggtgcttgtaattgcaagttttctttgtttgtttgcttgtttaaatctagaaacagagcatctaatctctttctggaattcctttttttttttttttgtttctcaggctggtctcaagctcctgggcgcaagcaatccgcccaccttggcctcccaaagtgctgagattacaggcatgggccaatgtgcctggcctgaggcctagaattccatttttaagtaaggagagaaggatcagagtctaaagttcatagattgttttctagcatgtgtgtctctgtggctgcctgcaaggctcttgggagcaatcactacacaccaagtttaggcacaacttccagtttttatttgtcagatcagagtaaaactctcttccttggacagtgcttgatgtatatcagaaagcaaaaacttagatggggttcagtttgcagttcacagaaatgcagctttttgggaaacatatttttaagtataaaaccagaatcttgagtcatttgagtagcattttattctagttttggaactttggattccatgtctccatccagcaattactgtctcttgtgcagataaatcatctttttgtggcaaaacaggaagcagcgtggtacaaaaacaacaggagggaaaggtactcagtgattcactgtatttgcttgactgtttcagaccaaacccaaaagccgaaactactttgtaataagagagtctttaaaggaagtacacacctgaagccagttccttccgtttcctctttcctttgtgtgcccctaggatctaagtccattctctcctctgtgcttagcccttccctctatatttgttgagtcctggcaacagtcagggtgagaaggaacccatttcattcaccattgtctctggtctctcttctgtgacaatatatcggggttttttcctgctaagtaacatgctgacttctagcctgggatggttttgttttctgttaacttctacatgtagcattacagaaaatttagaaaagagagagagagaaaaaaaaagcacccacaaacccaccagcctaacataattactgtgctcattttcaaatatttcctatgagcctatacctgtatatgattctttctgtggctgtaataatagtgagtgtatctatctatctatatagatatatatacacacacacccacactcttttattttgaaaacttgcaaacctacagaaaagatgaaagagtgatacagtgacggtctggagatctcctttgcaaaggaacatttttctccattttggttttatttatttatttatttatttatttatttatttatttatttttgagacaagtctcactctgttgcccaggctggagtgcagtgtcatgatctcggctcactgcaatctctgcctcccgggttcaagcaattctctgcctcagcctcccgagtggctgggattacaggtgcccgccaccatgcccggctaatttttttgtatttttagtagagatggggtttcaccatcttggccaggctggtcttgaactcctgacctcgtgatccacccgcctcggcctcccgaagtgctgggattacaggtgtgagccaccgcgccaggccattttggtttttaaataccaaaaatttgaaatgaactagggctcctggaagtaatggttgattccaggactggggcaggaaaagtacaagatgagcctggaacatattgctgtatttaaagcaaggaacagctgaaaatgaaaggggtatgagttttccaaggtcaaagaagccagcttgaaagggcacccactggccttattttggacaatttgaacatcaaaaagaacaatgacagtattagattataacacatttcattttctgaaattccatgagtccataataatactaagaaaatacaaaagcaaagaaaaaagaaaagccaattaaaaatgtagatgtcatctctgatgtaataatggattcaaataaggatcatcagtggatgctaaagccactgggtgaaatttgtaagaaacagaatattcatatgttttcagaatagcaccataaattctttattaattacagaagtttgtattttgaacttaacacttcatatgcatttttccaagttgcatgaagttcatttttaatggctgcacacttcaccattcactcaacacaccccctatgttaaagcttattctatcccagccactgtgctgggtgcttgaataagtgcttaaataagaacatgttccctgacctggggactcatcaggtagtataactgttctctaaattttgggaggtgacagacttccaagattgtgatcaaagctgtgggcccacttcctggaaaactgcccaaacataccactttgtagtttccttacattcatacccccaatgctacccccgtcccctgcatccatagactttcttctaggggtcttcagctacagaccttcccatccaggaaagggcacagacctgcaagcgcacagtcccagcagtgtgggaaatgctggcattagagcttgttctctctttcgtggttgtacccagggaatgctcccaggttgccaggattaactaacattaagattaatatcttcctgcaagtggtaccatcacccacacagtgtgacctggctggactcccctggggaagctcagattcctcctccctcatccccattgctcatagtcagcaggtgctggcaattcctgttgttggaattcactccatcttttgtctattttctgccatgctgcaagggagtatggcccggagtcaggactctagctgtcaaccgagttcaaactggctcttttacttcccagctggctgtgaccttgctcttctgtgcattgctttctttataaaaaggggatggtaatagtccccacttgacatggcagaaatgaagattaagtttcacactaaatgtaaagcactgagcgtagtgcctggtctatggtaggaacttaaatgggaattattatgatgatgctattattattacttttcctttagttccagtatctatctcttgcctactgcaaagcctcctacttggtttctctgcctccagcttgcttcctcccaatccgtcttctgcggttggaatgatctccccacattattttggaacttaaacccccccccccccgatggcttcccttggtttataggataaaatgcacacaaatccatatggaacagcttgcagttccctgaactccccagagggttttgcctgttgtgtcttgatacacattcctgacctgcttagtgagaggggaatagggatctatatcctattagaatggttgttcacggactcgttaggtgaacaaggtgaatcggaggtgacaaggtggcgaatcggaggtgaattattaggtgaattgcaggtgagagtggctccctccattgttcacagagggtgcatttcactctcccaggcatgcttctcttacgttgcgtggctctgctctctcttggacttggagagcaaggtactcttttcccttgcacaaatccgacattctgtttccagcactgcttgaaacttggaatcgctttgtttcaaacttggaatcactttgctttttgactttgagttgcatggttgatgttgccaggggccattcttgcaccatgtggtgcaaaaatattttacttctgtggggacactattgacaagtagggtagatgctatggattttacttctgcgtctgctgcttattgagtaattttgtccaagtcactactcctaaacttgctgattctcctccttagggccgctgtgagggacagttgaggtggtgctttataaactcaactgctatcaaaatgccactttccccgctttgttacacttcaagcaaaagtgaactgaaattaacaaaagattctattttgctttcttttgaactgttcttttaaacattttagaaaaccattcacccctgtgattgtttgacttcaactccataccttgagatattttttagggtaaattattgttaatgaaccacatttgagtacaccttcccttggggtgggataaacgttggttaaaaggtgcttttaaccagatcacggtgcactgcagtgtggatggtgtggtgccagacacgaatggaattaatagtactacagactaccgtgtgcttttaccaccctgcctgggtggtattctactgtttactatgaaatataaaactcattcaaagcagactaagtttttgttccattgttcttatattttatggcttccaggggccctttatgaaggaaataagtatagtagtaatactgctttggggaaaactgtgttcatgacaatctgtttttaaaacatgctgtttcacaggaaacggattttaatataaagtattgtaaggaactcatgcatgctgggaatcctaactatgccattaaaatctttaaattccaaccacctctttctgttaatggagaagaaatggtttaacagctgccttggggtagcgtaaaggtgggctatatgaggcattgctataccctttccctagcaccttggaatatctgttttcttatgttgggaatttattgggagccagaagtccttgacaagcaaacttcactatgacaaacctttcgtttgtcaagagccacatgttggctgggcacagtgggtctgtaatcccagcactttgggaagccgaggcgggcggatcacttgaggtcaggagttcaagaccagcctggccaacatggcgaaaccctgtctctactaaaaatacaaaaattagctgggcatggtggtgcattcctgtaatcccagctacttgggtggctgaggcacaagaatcttgaacctgggaggcagaggttgcagtgagccaaggtcacaccactgtgctctagcctgggtgccagagtgagactgtgtgtcaaaagaaaaaaaaagggggggggtgccgggtgcggtggctcacgcctgttattccagcgctttgggaggccgaggtgggcggatcacctgagtttgggagtttgagaccagcctgaccaacatggagaaaccctgtctctactaaaaatacaaaattagccagacgtggtggcacatgcctgtaatcccagctactcgggaggctgaggcaggagaatcgcttgaacccaggaggtgaagattgtggtgagctgagattgcgccattgcactccagcctgggcaacaagagcaaaacactgtctcaaaaaaaaaaaaaaaaagaaaaaaaagaaaaagaaaaagaaaagaactacatgttgaccattgtggtaaagtcttgtcagtatagtgattcctctgtgttgctgctggtgattttggttttgtcttgcaagaaatggtaccataaaatactttttaaaaagagagttttcatgatttgggaggcacacgcatgcataagagatatttgctgtgattttcattaatggtagatagacctttaaaaaaaacttttggccctttatttccttctcctgtctaattgccctggcaagaacttccaacactatgttgaataggagtgatgagagagggcatccctatcttatgccagttttcaaagggaatgcttccagtttttgcccattcagtatgatattggctgtcggtttgtcatagatagctcttattattttgagatacgtcccatcaatacctaatttattgagagtttttagcatgaagggttgttgaattctgtcaaaggccttttctgcatctattgagataatcatgtggtttttgtctttggttctgtttatatgctggattacatttattgatttgcgtatattgaatcagccttgcatcccagggatgaagcccacttgatcatggtggataagctttttgatgtgctgctggattcggtttgctagtattttactgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccaattcctccttgtacctctggtagaattcggctgtgaatccatctggtcttgtactctttttggttggtaagctattgattattgccacaatttcagctcctgttattggtctattcagagattcaacttcttcctggtttagtcttgggagggtgtatgtgtcgaggaatttatccatttcttctagattttctagtttatttgggtagaggtgtttgtagtaatctctgatggtagtttgtatttctgtgggatcggtggtgatatcccctttatcattttttattgcgtccatttgattcttctctctttttttctttattaatcttgctagtggtctatcaattttgttgatcctttcaaaaaaccagctcctggattcattaattttttgaaggattttttgtgtctctatttccttcagttctgctctgattttagttatttcttgtcttctgctagcttttgaatgtgtttgctcttgcttttctagttcttttaattgtgatgttagggtgtcagttttggattttcctgctttctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaccttacaagggacgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatcccaatcaagctaccaatgactttcttcacagaattggaaaaaactactttaaagttcatatggaaccaaaaaagagccctcattgccaagtcaatcctaagccaaaagaacaaagctggaggcatcacactacctgacttcaaactatactgcaaggctacagtaaccaaaacaacatggtactggtaccaaaacagagatatagatcaatggaacagaacagagccctcagaaataacaccgcatatctgcaactatctgatctttgacaaacctgagaaaaacaaggaatggggaaaggattccctatttaataaatggtgctgggaaaactggctagccatatgtaaaaggctgaaactggatcccttccttacaccttataccaaaatcaattcaagatggattaaagacttaaacgttagacctaaaaccataaaaaccctagaagaaaacctaggcattaccattcaggacataggcatgggcaaggacttcatgtgtaaaacaccgaaagcaatggcaacaaaagccaaaattgacaaatgggatctaattaaactaaagagcttctgcacagcaaaagaaactaccattagagtgaacaggcaacccacaaaatgggagaaaattttcgcaacctactcatctgacaaagggctaatatccagaatctacaatgaactcaaacaaatttacaagaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagatatcatctcacaccagttagaatggcaatcattaaaaagtcaggaaacaacaggtgctggagaggatgtggagaaataggaacacttttacaccgttggtgggactgtcaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacagtagcaaagacttggaaccaacccaagatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccacatattctcactcataggtgggaaattgaacaatgagaacacatggacacaggaaggggaacatcacactctggggactgttgtgggttagggggaggggggagggatagcattgggagatatacctaatgctagacgacgagttagtgggtgcagcgcaccagcatggcacatgtatacatatgtaactaacctgcacattgtgcacatgtaccctaaaacttaaaagtataataataaaaaaaaaaacaaaaaaaaacttttggcgaggcatggtggctcacacctgtaatcccagtactttgagaggctgaggcgggagtattgcttcagtccaggagttctaggccagcctgggcaacatagtgagaccccattcctacaaaaaataaaaataaaaggttagatgggcacggtggcatgtgcctgtagtcccagctactcgggaggctgaggtgggaggatctcttgagcccagaggtggaggctgcagtaagctgtgatcgtgccactgcactccagcctgggtgacagagcaagaccctgtctcaaaaaaaattttttttaaggaaatgacaaggaccattgcatggtgactgtagtttgctttttaaaaatcattattcatttgtttttagatcagtactatccaatataactttctacgctggtagaaatgttctataatctgcactaccatatatggtaggcactaggcgcacatggctactgagcacttgaagtgtgacaggtgcaaatgaggaatggaattttaaattttatttcattttaactgatttaaatttagatagccactgtggcttgtggctaccatattggacagtgcagtttaaaaattttcccctcttcttgggaggccgaagcgggcagatcacttgaggtcaggagtttgagaccagcctggccaacatggagaccctgtctctactaaaaatataaaaaattagctgggcgtggtgatgggtgtctgtaatcctagttactcaggaggctgagacaggagaattgctttaacctgggaggtggaggttgcagtgagcccaaatcactgcactccagcctgggtgacagagcgagacacactatcttaaataaataaattaattaaaaatttcctctcttcaaatgtaacaagacacatagggacatgtctgtattttataccacttcataaaatttaacatgcaagactctaatatatgataattcttccctgtgagaaacgtgtgtgtgtgtgtgtgtgtgtgtgtgtgtaaaagattgctgaaaaagataggttagtcctaagatagagctggatatcttgaattaaatgaaaatatacccagacacatctagcttatgacttaagtttgttctgtgtgaaacagaaatgaacccggcatagagtagcgctcacggcgcatatgcagcacagagtgcactcacattttattgcatgtgcaagagccactgttggtctgcattcagatgacccacattttatttctagcagttgttttttattggcagatgaacgtcctaaaatcagcaagttcagcagtaacgtatattttgataattgtgttcttgagtgtcatggtttgttttattgtcctaccgccagtctctgaacatatgaaagacaattagtgaacccagtcattaagcttggagatgaataaattcaagctgaacttcattttgttaaactcagcctgtgccatttggatgtgttggcagagcttggggcagacagccatcagataggaaatgagagctgttagattagaaacaggcccgcccaagtccacttgctaatgtgggtaggaaattatacttggcataggaaacaatcctgaaaatcatacacttagcagtttttattggttctttatgtttccatgactgtttgaggagataccaagttatgaatatataacccctatcaatagcaacatcttatgtttttatatagttttcagagcaagtttatacagtttcttttgactctcaaaacattttggtgagtttggaggtattattgccattttttctagactcagaagtcaatgacttgtccaaaggtacgtggctcataaatagtataaccaggagtgtggggggaagatatgagcccactgtattcttccccaggcttagagatggggaaggaagtgggtgtaaaatctggcacgcaaggaaatgaagttccctcagtcctttggcccttgtcacttgcgttaggggacatgccctagtgggtcctgctgccctacctgtggcacagcttaaaccctaccctgtgccccgagctagtataatggggattctggcttcaccttgaaggatctatgtgccaagtaagtcacttgaacgtccttgaccttcatgtcatctcagataggaagttgagtgcaacttccaaatcccctttcttggctaattctatgacacaaaatgttgcatagaacgaggaaggagtctccatttgagcagggagagtgcatgaataggatgtatcagcttttttggctgttgttttttttttcctccaaatattcttcagttattcctatgtaccagtagaagggatttctctgaactaaagtctaagtaggaggtatctttctacttgattggttttaaggatatgttgttttatatgtttatctaacatatgttgtcttttctgccagttctgaatcttctatctcctctccttattctagtgctccccccacccccgccaccacctacgctgtttttgttcaaaagccagagaaggaagtgagcatgcaaatcaggaaacagattgtctttttgcctatgcagatttgtctgtgattttgtttatttattaatattcacttagcatgtttagagtaaaatcttccttttctagtctatcagcatagggtttctccaattgttccctttcctcaaaaaaaaaaaaaaaagtaaaatttcacctgttagggaattcagactttttttttttttttttttgagacagagtcttgctctgtcgcccaggctggagtgcagtggcgcgatcttggctcgttgcaagctccgcctcccgggttcacgccattctcctgcctcagcctcccgagtagctgggactacaggcgcccgccaccacacccggctaattttttgtatttttagtagagttggggtttcaccgtgttagccaggatgatctcgatctcctgacctcgtgatccgcccaccttggcctcccaacgtgctgggattacaggcgtgagccaccgcacctggctgggaattcagacttttattgctataaatcagcaaaagtttggccaagactggggatgggtcaggcatgaaacatttccttgtaatatcatctccatagatcagtagaactctagtggagtagatcagtgtgctgatttatttggaactgagtaaaaggaaccacaaacagaccccacagctcagagtgaaagttgagttgcagagctatctcatggggaaggggtatttctaaggcaacccaacctggcgatatttgtcaataattggtcctattttgaatactttctgtgactcaaggtaatcagggcattccatatatttctaattttgaaatttgcataattgtgaaaattatttctccaactcttggacctatgagaatgttggaagggaaaactttcacgctgctgacctaaaatcataatgaaaacatgatctgaaggagataacatttcaaggcaagtgtagagagtgcgttaacattttttatgtcactgcagggtgttttctgggtcttgagccaatatgcacgtcttagtcctcatgaccaccaagttcaagctcctgtgcaatttgctgatcgtagatgactagttcctccgtaatgaggaggtgctgtgattctcaagcacggaggccagcacagatctggatctagggaggtgctgtggtccttaaaacacagagccaaaagccaaactgcagctgaaaagaattacagcatttcgctaatgtaatcagggatacacagctgtgttcactgttctctagtcctttcatgttgctagaggggagaaaagatagtttttcctctacccatcataggttcatggccaaggccctgataacaaaaaaacagattaacaagcaaaaagcatacagttgggcacagcagcaggtgcctataatccctgttatagcaggtgcctataattccagttacttggaaggctgaggtgggaggatcccttgaggccagtagttggagactagcctgggcaacagtgaggcaccacctccccacactcacacacacacacactccagccccatttcttaaaaaaaaaaaagagacagagaaaagcatacaaatttatttaatgtaagtattatgggaaccttcataaggaaatgaagattcaaagaaacaggtaaactctggtctttctaaaacagacctgatgaagagtagagagtcatggagagttataatagagcaaaaagagtgtgatctcatggtaatatagtaggggaacttagcaaggcctgtttattcagattcttccctgggatcctgtgtcttcagagataaggatactcgtttcctctgggtatgggggttgggggtacctctcacctgagggccttttgacctgcttggagaaggtcagaaaatccttccggggtgttatgacctgcttcagtgggggaaggtcagaggaaggtcagagagaacttcttgcacatgctgtctcaaattccttccgcttcatgcaatgtatatgtgggggctgttatggttagagtcataatagtctaggtcaggggttgacagactttttctgtaaggttagagagtaaatatgttaggcttatgagccatacgcaatatgccaagatgccatattttggggtagtgtgtcctgaactccctcattgccaaaggaaacagttgtcatcagaagaatgaagaatgaaaaaaacaaactgaagatccaggtaatatcgtatgctatgttattacattgaagaacaaattgacatcagtaggagtaggactaagtgatgctcaacctcagatggactgaggtttagtccctagtatgacaagagtagattcacagaaaataaatgggtccatcaactcaggctttcattttaaatcagtttgttaatataacacctctagtagaaagcaagcaatagttaaggtggcaggaaggcaatctactttcaaggcttttattaaagtttagaaatgatcagtggtcttcagaagattataaatttcagtctaaactgaaatgcgtttttaattttctgaataagtaacttccagtttacgatgaaaataagtgatcagtttctctgaccaaagaaagaggccattgcatgtgattggactgacctcttcctgtggtgactagaaagtgctaaaagaatattctttagtattttctctcatactaaggggttaatatggaatgtgtttgaaattgcaaattgaataattgtccaggttttttttttataccttgctaaattagttcctcttttaatctagtgatagatacagtgatgccagtgatgacagcttttcagagccaaggatagctgagttggaaataagctgaaatgaatacatgactgggaataatggggactgcctgtgagggtaagatggaatcttcgaggattgttcatttctctcatggacaagctgtcatcttggtatagaggcgggtattataggactcgcctcacaggatcttgcccctttgagatactcccatttgactggcacagttagcaggacacgcatgacagcccatgacagagttagtgtttggggaaaatggaatgcaccttgggccaggaaaaaaaaaatataagtacacctataaatgtatatgtgggggctgttgtggttagagtcatcatagtctaggccaggggttgacagactttctgtaaggtcagagagtaaatatcttaggcttatgagccatgcagttcctgcggcaactactcaattctgctgttgtagcaggaaagcaaccatagacaatatgtaagtgaacaagcatggctgtgttccaataaaattttatttacaaaaacagtttgctgatccctggtctaggccactcatagaagagcagatttccttggatttgtataaaataaaattaaaataaaataaaacataaaataaaataaaataaaatagtatttgatttctttgtagggagatgcaagagacaggcttagtgtccaagggcagcttatttttccattgctctattatgcactattagagagaataccagcctggatagcttcagtaaatttatgctcagtggcagatagtgcctggattgccctaggcattatggcaggccttgacttgtataagctgttctttagcagagacagcagcttttggaagacttgtaaagtgttcattgctttcctgtgaggtctcttcatgtttatcagggaagatgcaaagctgtgtctatttagttttgcctcaaacatggagaccctttggagcaagccaaaatggtgcaaaggttagctggagatattgaaagacttgtattattcagttcctggtgttgctaatatttatattcttttcttttaagcctctgaaataattgaaggcaagatgaaggaactatctgaagaaatcactacactcttagagaatccctctgttctccagcaaacatgggatgtaaagcctcacagggaatctgataatacatacttctgtcaaccagaaccagaggggtagttttcttttccctccagaggcagcctttggtacttaaaatatctgtagctgattaaatttttcccaacaacctcactggggagaaagtgtgttcatgttttgtccagcggatcaggatgttaggatgacgagcaagagtccaggtcactgtgcctttgctgtgttgtatggaaaggatggcagggaacatgctgtaagtaattttgagtaagaaaatgagtcactgtgttacctggaactcagccacagatttgtgtgtggtccaagatcattgcagtttctcaccctgtttatttcctggtaaaagtaaaattgaataggtccaagacttgggggtggcaagtaaggctttgcctcaggcacaaaatttaagggggctccaaaaaactcaggaatcaagatcagcaatacagtctgagtatcccttatgtgaaatgcttggggctagaagtgttttgaatttcagattttggaatatttgcatatacatgcgatatcttggggatgagactcaagactaaacatgaaattcatttatgcttcatatacaccttatatacatagcctaaaggtaatttgatacaatattttaaataattttgtgcatgaaacaaagtttcgactgcattttgactgtgatttctggcatgagatcagttatggaattttccacttctagcgtcatgttggcattcagaaattttgaaattttggagcattttggattttcagattagggatgctcaacctgtatatatattttttaatcgacgtgaaattcacgtaacatagaattaaccattttgaagtgaacaatttggttgcattcactgatgttgagcaaccaccacctttaactatttccaaaacattttcatcactccaaaataaatgcctgtacacactagcagtcactccctatcttcccctccacctgtccgctggcaaccactgatctcctttttatttctgtggctttttctattctggatatttcatataagtggaattacacaatatatgtggtcttttgtgtctggcttcttctgagacagtaggaaggggggcttggctttggctcacccccactagagcattttttcatgcattcccactgatcacaaaacccatactactacctcattgacaccatacctgctaacctcgaggctttagtcatacaaagaaaatggcctttctgtattgttcttctgtgctctcataatgcttaaccatgtcttttacttaaacaattccaggaactggccttaggagatccaaatagggaaccaagattgcagagtgtcccatcttggg

SEQ ID NO: 5512 - DNA, 124630 bp, human
aaaggcaggcattctctttccttttccttctctcctgagcgctcctgcagttcctggggcgtagtaggggatccacaagcgtttgtgaccagtgaagttctttacaagggtgagatctgcacgggaggacccgagcgagggtctcggcttgccaggaagccggggttccccgggaagcgtggagttcacccgcgcactcgaagtgcctttgcaaagtgagccacgggagggaggagcggtccccgggctgggcgaggcctggggcccagtgcgtccagagcggagggtgacgggagctgcctgtgctggaggaatcactttttaggcgcttgttttggaccattgcacaaacccgggtgcaaaccccaagctcaccagcgtgagtgagctgggccagcagcagggaggagaggggaaggtgggcgaggagggcgccgcgcaccccgaggcccgtgtgggcggtgggaagatcccgggggcggctttggacagccccggcagcgaccccttccccagcccgacaggtgagcgccaggccagccgcggggtggagcccgccgtgcccaccggccaccctccccggtgctaccaccaccgcgcaggtaacttcccttctgggcctgtcccagacccccagggcctcggcgcccgggccatccctcgtccccagggcctctccgccctgcacccccagccccggtgcacttgtggggccgggctcctttgtccgctctctgatggcgccggctccctgcccagcgctgagtcgggtccggccgccagccccgcgctcgcagacctcggctgccgggtgtggcgcggggactggggaacgctggcccgtgcccagtgcggttggagcctgtcccgcgcgtccccgggacgcgcttcttcccgcctccgcccgcgccagcgcccgcacccggatccccacttctcccggccctcgggagccaggagagccctgagatggcgttggcggaagtgaagccccgagcgggggtctgcgaggctggtgatcagcgccggtaacatggcctttctgtcctctccccggtcccagtgcaccccttaaacaacgacccccgcgttttccccgtactagatggttagggcgcatagtgccgaactacgctgctgctacagaatagcttttttgggggcaacataaaaaagaattgtatgtatggtttatatacaacaaaatgtcccattttcagtgtgcaaatcgacgggatttgacaaattatacactcctgtaaccattatcccaaagtgaacattgaccatttccttcaccctgcaaagttccctggtacctcctttctgtcaatccaccccaggccccgcactcaaccccggttctgattgttatcatagcttagctttgactgttctagaacttcatagaacaagatcatcaggtaagtactcttttgtgtctaacattactttttaaatggccatcactgagaaggtgtctctgggtgcttccggtgcttttatttgctctaggcctgcctggtctaatgtgggagccactggtcacatgtggttattgaatactggaaatgtggcaaaatccgtactgagatgtgctctgagtacaggcacctgatttctgaaagcttagtacacaaaaaagatgtcaaatatctcactaatacattcttacattgtgcgttaaaagtgataacatttttggctacattgggttaaataacatatattaacatgaacttcatttgattctttttacttttttaatatggctactagaaacttaaaattacgtacctggctgtgtaatattttttattaggtagtggagacagcacagctctacactgtgctatcctataaacacttggttctgctcactgcatgtaagagtaaatgaaaaacttgtcttgacaccagaaacaatcctcaatggaggaagtgatctaaaacagggccagcctttccctgaacctttgaaactttgttaaacttacttgtgtgcttaaaagaagtagagggccgggcatggtggctcatgcctgtaatcccagcactttgggaggccgaggtgggcggatcacgaggtcaagagatcaagaccatcctggacaacatggtgaaaccctgtctctactaaagatacaaaaattagctgggaatggtggcatgcacctgtagtcccagctacttgggaggctgaggcaggagaattgcttgaacccgggaggcggaggttgcagtgagcccagatcgtgtcattgcactccagcctggtgacagagcgcgactccaactcaaaacaacaacaacaacaacaaagtaggaagaattaggtgtccccttggtattaagttgcatttttacaaaaggtctctaaaatatccaaggtgctttaaaaaggtatcttgtgtttttgaaaaaacagaaaatgagcaattgcttatgtaggggaggaaagagctgatatcataagggtcacggctgacagccttaaacaagagacagattaacaagagagaagcataataatttattgaatcataggtttatgtgacatgggagccttcagaaatgaaaaccccttaaagatgcaagggaaatgatctgattttatgcttggagtccatgaagcagggacagatgagctaatggaaatagactgagtggggaaacccagcaaagcctgtccacattcttcttggcctctctgttgtagcgtttcttcctccccagtatggggtaggacctctttggaatgagggtcttaatttctttatggccagctgttgtatagaaaggtggttgagaggaaggttagagtcatattttttggctttatggctggctttggggggaaaagggttctagtttctatgacttgccttgggggagtatgaggggtgagagacaggagggcaggagaaggtcagagagaaactttgcttctgaggccttcatttttgggttttgttttctgagccccaacacatacaacctaatcacctaaatatattaagacataacatggtgtatctttgaccaaattaagatagaaatctgtttttttttttttttttttttttttggagacagagtctcactctgtcaccagggtagagtgcaatggcacgatcttggctcattgcaaccttcacctcctgggttcaagtgattctcctgcctcagcctcccgagtacctgagactacaggtgggtgccaccacgcctggctaatttttgtatttttagtagagacaaggtttaaccatgttggccaggatggtcttgatttcttgaccttgtgatccgcccgccttggcctcccaaagtgttgggattacaggcgtgagccattgcacccggccataagatggaaatcttagtggtgacaaataaaatttagatcttagtttaaaaaaacatagtcaataatatattcaattttatagtctgctctctttttcaggtaacataagcattttctttcttcctttttttttttttttgagacacggttttactttgttgcccaggttggagggcactggcacaatcttggctcactgcaacctccacctcccaggttcaagcaattctcgtgcctcagcctcctgagtagccgggattacaggtgcacgccaccacacctggctgattttttgtattttagtagagatggggtttccccatgttgcccaggctggtctcgaactcctgagctcaggcaatccgcccgtcttggcctcccaaagtgctgggattacaggcgtgagccaccgtgcccggccacataagcattttctttttttttaacttttttttttgagacgaagtctcgctcttgtcccccaggctggagtgcaatggtgctatctgggttcactacaacctctgcctcccgggttcaagcgattctcctgcctcagcctcccaagtagctgggattacaggcgcctgccaccacgcctggctaatttttgtatttttagtagagacagggtttcaccatgttggccaggctggtctcgaactcctgacctcaggtgatccgcctgcctcagcctcccaaagaagcattttcttatacaaaaatttattaggcataatgtgacttgtacgaatgtatgccagttttcttcaccatacctctacggcatttttccatttcggtaacttttacaaagagagtcatttgaacagtataacagtgccagaataaggtataattaaagcacagtttatttgccccttaatcctgcaggaaaggtgaagtccagtggaacatagaccttgtctttttgtttatctccatattcctaggacttggaaatatgtcaagcatgtaatagatgttcaaataaacattatatatgtaatatatgtatatatataatttatttatttatttatttcagacggagtctcactctgttgtccagactggagtgcaatggtgtgatcttggctctgggtttggattgacaatgttttaagctataaacataggtcagataggtgggtgccctggtgactagtgaagatgtgcgatggcattgaatgtgatcaactgtgttgtgtagagaaaggtaggcccagggacttagggaggccatctgggatggaacatgtatattttgaatagcttcagtttactcagcctgaccatggtcagctagttcaaatggaattcacagctctgacgtgtgataactttagttaagatagtttgttttgaaaggtaagcagaggaaaccacaaaatcagaatgggcattcctttgaggaggacaaataagaagtgggtaactgaaattgttcctacccgaatgcatttgtgctgaatttccaagtatgtaaaaaaattgtgaaattacaaatgaaagtgaaatttatagttattaccttttgttagttactgtctctctctctctctctttttattttttcttttttggtaccgagtctcaccctattgtccaggctggaatgcagtggtgtgatctcagctcactgcaacctccgcctcccggcttcaagtgattctcctgcctcagcctcccatgcagctcatgtagctgggaccacaggcacacgccaccacgcccggctactttttatatttttagtagagacattgtttcgccacgctgaccaggatggtcttgaactcctgacctcaggtgatccgcccgccttggcctcccaaagtgctgagattacaggcatgagccaccgcacctggtctctctttttatttttgagacaggatcttgctttgtcacccaggctggagtgcagtggcacaatcacttggctaactgcagccttgacctcctgggctcaagcaatcctcctgcctcagcctccccagtagctgggactacaggtgtgtgccaccacacctggctaatgttttatttttcttttgtagagagggagtctcactatgttgaccaggttggtgtcgaacttctgacctcaagagatcctcccacctcagccttccaaagtgttgggattacagatgtgagccaccatgcctggcattatttttctttttctgtaactgtaattttatattgtggtcttactcagttgcccatttgcctgccatgagtacacaaataatactgtttatggtctactttcacatacatggtgaaattacaagagcagaaggcccctgtacacactcaagggaaaaacaatagtactcaaagtaaagaaaatcaagttattgggcttcctataaaacaaaagggtttgaatcagaaagcagcagaaaagtcaaataaattttccttatgactgtcaacttaaaaatcacaagatctataaatttagaaaggagactttcttttttaaaacattttcttttctttttttttttttgagacagagtctcactctgttgcccaggctggagtgcagtggcgtgatctcagctcactgcaacctccgcctcccaggttcaagtgattctcctgcctcagcctcccgagtagctgggattacaggcgcatactaccatgctcggctaatttttgtttgtttgtttgtttgttttttttttgagacagagtttcgctcttgtcacccagactggagtgcaatggtgcgatctcagctcactgcaacctcctccacccaggttcaagcaattatcctgcctgagcctcctgagtacctgggattacaagtgcccacaaccacgcccggctaatttttgtatttttagtagagatgggatttcaccatgttcgccaggctggtcttaaactgctgacctcaggtgatccacccgccttggcctcccaaagtgctgggattacaggtgtgagccactatgcccagcctaacttttgtattttttagtagagacagggtttcatcatgttggccaggctggtctcaaactcctgacctcaggtgttccgcctgcctcagccttccaaagtgctgggattacaggcatgagccattgcacctggccaaaatttttcttacctttcgagtcggagtctcactctgttgcccagaccggagtgcagtggcacgatctgggctcactgcaacctctgcctcccaggttcaagtgattctcgtgcttcagccccgcaagtagctgggattacaggtgcctgccaccacacctggctaattttttatttttagtagagacagggtttcaccatgttggccaggctggtctcgaactcctgatcttaagtgatctgcctgcattggctgcccaaagtgctgggattataggcgtgagccactgtgcctggtgactttatttcttttcttttctttctttctttttttttttttgaggcagagtcttgctctgtcacccaggctggagtgcagtggcacaatctcggctcactgcaacttccgcctcctgggttcaagccattctcctgcctcagcctccctagtagccaggattacaggtgtgcaccaccacacccagctaatttttgtatttttagtagagacagggtttcaccatgttggtgaggctggtctctaactcctgacctcgtgatccacctgcctcggcctcccaaagtgctgggattacaggggtgagccaccacgcctggtttactttatttctttgcaggctgtaacagcctgcaaaggggccatcccacaggctgggaagcacacgttttaaagagacagggtctcgctatgttgcccaggctgttctcaaacttctggcctcaagtgaccctcctaccttggcctcccaaaaccagaggcaggcactctgaaggagggttcagttttatgctgaatgggttggctaaatatacatattcaacaggttacaggaggagctatgaatattcatgaaggtggtcctgactcatgtgtattgaataaacatgaaaatagcatatgacccctgttcactttggggatggagacttaacatttaaatgaatttcagttaagccctatgcatcaaaagatctttccaggacatgaaggcacgcaagtccacagcctctgtaaactggccagagccagtccatggttggtggtcttatcaggagaaagttactcaaatcagtctcttgtccaataaaagctgtagttttgactggtgtaacaggactcagtcagtcagcatctgtgagctagatgagttgtaattattttaatattgcttatttaaaaacagtttttattttttatttttttgagacagagtctcgctctgttgcccaggctggagtgcagtgagccactgcacctggcaagacttttttttttagagtaattttaggctcacagcaaaactcagtggaaagtacagagttcccatacaccctctcccccactgctatgcccagcctccctgactattaacatcctgcacctgcagagtggtacatttgttataatcagtgaacctacattgacgcatcatttttgcctaaagatcataggtttttgttttgtttttttgagacggagtttcgctctcattgcccaggctggagtgcaatggcctgatctcggctcactgcaacctctgcctcccaggttcaagcgattctctcttcctcagccttcggagtagctgagattacaggcatgcaccaccacacctggctaattttgtatttttagtagagacggggtttctccatgttggtcaggctggtcttgacctcccgacctcaggtgatctgcccgcctcagcctcccaaagtgctgggattacaggtgtgagccaccgtgcccggcggaaagtctgtagtttatttacatcagggttcgctcttcctgttgtccattctgtgggtttggataaatgtgtaatgacatgtatccatcattacagtattatacagaatagtttcactgccctaaaattcctttgtattgtgactattcatccctctctccctcctacccgctgacaaccactgatctttttactatctctctagttttgctttttctaaaatgtcatatagttgaagtcatacagtatgtatgtttttcagattggcttctttcacttggtaatatgcacttgagattcctccatgttttttcatggcttggtagcccatttttttttaacaccaaattatattcctagagattgttgtatattttccactttacagatgaaggaataggcacagaaaggataaataacttgcccaaggccgggcgtggtagctcacgcctgtgatcccagcacttggggaggccgaggtgggtggtcacttgagaccaggagttcgagaccagcctggccaacatggtgaaatcccatctctactaaaaatacaaaacttagcccagcatggtggtgcatgcccgtaatcccagctacttgggaggctgaggcatgagaatcatttggaccggggaggtggaggttgcaatgagccgagattgtgtcactatactccagcctgggcaacagagtgagaccctgtctaaaaaaaaagaaaaaaaaaaaaaaaagaacttgcccaggtacagtttgtacagatcagtctgacactggagtctgagctcttaaacattttagcatgcctgtgaatcctagagaaatttggtttatcatgatgaagtttgttgcatgatagagttgaggtctttggaaacccagggcaacagacctaggcactttgcttgcagaaggtatctacagctttctgtatagtgacaacaataaaaagcctagaagataagactttgtttcaaaaaattcaagtatttagtttggacagaaaactgctgtgtgcttttgaaattttggtgagacgaagcatggtggctcacttttgtaatcagcatcttgggaggccaaggcaagaggattgcttgagcccaggagtttgagaccagccagggcatcatagtaagaacctgtctttacaaaaatgttttaagaattagctgggagacgtggcacgtgcctgtagtcccagccactctggagcctgaggcaagaggattgcttgagcccagaagttcaaggttgcagtgagctatgaacatgccactgcactccagcctgggtgacatagggagacactgtctcttaaaaaaaaaaaaaaattctgagctaggtgcggtggctcatgcctgttatcccagcactttgggaggctgaggcaggtggattgcttgagctcaggagttggagaccagcgtgggcaacatggtgaaactccgtctctacaaaaaacccacaaaaattagcagggcgtggtggtgctcacctatagtcccagttactaggatgctgaggtgggaggatcgcttgaacccagcgagcagaggttacagtgagccatgattgcaccactcactgcattccagcctgggtgacagtaagactatgtctaaaaaaaaaaaaaaaaaaaattaattctggttgaatacactgtctgctttactagttttaaatatttctctttccttatccataattttattgcctttcagattatatctgggtgttggcacccagccactattctgccaatgaagtacatcctggtcacgggtggggtcatctcaggcattggtaaagggatcattgccagcagcattggaacgattctaaaatcatgtggactccgagttactgccataaaaatcgacccctatattaacatcgatgctggcactttttcaccttatgaacacggtacgaaagtgaaccacttcccccttatagcactaggctcaactgcattctttcttccattttgggtaatttctttaggatgtagttccagatttagagtgactagatcgtatgctatgaatatgtgaattttctcatggtcattgatacattgttcatacctctgatgacattccaaattaatcatcccttttggaaacattgtatcttttgcactacagattctgttttatttttaacataaaggtagtgtgtttctcttaacatttcccactgcctggagtaactattattaatggtgacattttgatgtatgagtatatttgatttatttttaaaatggcattagcccttacatgctatttttaaaaaactttttataaggcccagtgcggtggctcatgcctgtaatcccagcactttgggaggccgaggcaggtggatcacgaggtcagaagatcgagaccatcctggctaacacagtgaaaccctgtctctactaaaaatacaaaacattagctgggcgtggtggcacgtgtctgtagtcccatctactcaggaggctgagacaggagaatcacttgaacctggcaggcggaggttgcagtgagccaagatcgagccattgcactccagcctgggcgacagagcgagactctgtctcaaaacaaacaaacaaacaaacaaacaaaaacaacaaaaaaccaacccccaaaaaaacctttttatatacaagcaaaaaagtgcataaatcataagtgtacagttggatgaattttcattaaatgaacacactgtgtaaccagcccctgatcaagaaacagaaatgttcatgtcctgccgggcgtggtggctcacgcctgtaatcctagcactttgggaggctgaggcgggcggatcacgaggtcaggagatcgagaccgtcctggctaacacggtgaaaccccgtctctactaaaaatacaaaaattagccgggcgcggtggcgagcgcctgtagtcccagctactcgggaggctaaggtgggagaatggcgtgaacccaggaggcgaacttgcagtgagccgagattgcgccactgcactccagcctgggtgacagagtgagactccatctcaaaaaaaaaaaaaatgtttgtgtcccttgttgctatcctgtcttcctgtttttgttttttgagacagggtctcactctatcgcccaggctggagtgcagtggccaagatctcggctcaatgcaacctccacctcctgtgctcaagtgatcctcctgcttcagtcccctgggtagctgggattacaggtgtgcaccaccacacctggctaatttatgtaatttttttatagagctgggatttcgccatgttacttaggctggtctcgacctcctgggctcaagcaatcctcctacctcggcctcccaaagtggtggtattacaggcatgagccactgcaacaggcatgagccactgcaccaggccttgaatatcgtgttttaaactttactaacctgagaataaaacaaacaaaaagagggtatcttattgttttaatttagagttctttgattttgattttgtttgtgaatgacttattcaagtctgtggtagattgtatttttgcttcaaaatgttacccaccatccctctgtggagtacatttccctgccctttgaccttggagtttggccacgtaggatagttaacttgtcctggtttgtttggaatgttcctgattttaaaacagaaagtcctgtgtcctgggagccctcttagtcctgggcaaaccaagcaggttggtcactctatttggccatgtgatttattttgtcctatgggatgttagggaatattaacatatgccttgttgaagcagaaaatgtcaaatgcatctgtgtggtttggctcagtctgtcttgtgcttctgccctctaccatgagaacagcctggttttcagagatttctcgttcagtctgggtcctggaatgagaagacacaaagaatagactcacaagtgactcatagcccccatgtaacatgagggagaaataaataaatgttttgtaagttgcagagattttggggttgtttgttgtgtggcaccattgactaatgccatgtgttacaccaaattttctttggatttttttttaatgattttttttttctttttttgagacagagtctcactctgtcgcccaggctggagtgcagtggtgtgacctcggctcactgcaacctccgcctcccaggttcaagcgattctcctacccagcctggcaaacatggcgaaactctgtctctatttaaaaaaataataggccgggcacggtggctcacgcctgtaatcgcagcattttgggaggctgaagcaggtggatcacgaggtcaggagatggagaccatcctggccaacatggtaaaaacctgtctgtactaaaaatacaaaaaaattagctgggtgtggtggtgcacacctgtaatcccagctactcaggaggctgaggcaggagaattgcttgaaccagggagtcagaggttgcagtgagccgagatcgcaccactgcactccagcctggcgatagagtgagaccctgtctcaaaataataataataataataatggtaatacaaagattagccaggcgtggtagtacatgtctgtaatcccagctacttgggaagctgagacatgagaattgcttggatccaggaggcggaggttgcagtgagctgagatcacgccactgcactccagcctggttgacagcgaaactctgtctcaaaaaaaaacattgaaaaaaaaaattgaaaaaaaaagtattgtgatatcaatttgcttttttccttaaaattaattttctagaccacagttatgtaccttagaatggataaataaattaggatataaaaggcttctgattaaatttgtaagttaatcaaccttttttcctgtggacatctaacagtaggaataaatgatagttcccttaataggggaaaggttcaattcttacaaggtggctttagaaacatacgactctcagtccatgccctgaagtgacaatagagatctacagacgtgtctagtagttaaagttggtgctcctcgtgtgacgaagtctgcacctgtcttttatgacagtgcattgtgcacgtagcttatggcacacacaggctttttccctcactttcaccaagttgccttatgggttagctgtggccttgctttgtcatctactgtctaattatggctttaatcaagatgagaatcaagtaaaagtttcttatcgcagttccagagtccaggatactgatgctttgaagtaaaatgctgtttgtttttaaaatttctgttttcatgtcttttttatgtggcatatgttgagtttggaaaagctaaatcttgaagacagaatttcagtagattaaaaaaaaaccacaatagaatattataaatagaattttctgatgcattttcttggatataattgaattgttaatatctccaccaaaaaggagatggtgatagaatatggcttacaaatacatcttttaccagctttttaacaaaaatatgtccatctttgaaaaatctactggaagcaaagttttgatttttccattgcctttttaatcctaggtgaagtcttcgtcttaaatgatggtggagaagttgatttagaccttggaaattatgaaagatttttggatattaatctttataaagacaacaatatcaccacggggaagatatatcagcatgtgatcaataaagagaggcgtggtgattacctggggaaaacagtgcaaggtattatattccacagacattatggagccctgtgtgctgaatatctttgtactgctcaaaagtagaactgaaggccgggcacggtggctcaggcctgtaatcccagcactttgggaggctgaggccagtggatcacctgaggtcaggagttcgagaccagcctgaccaacatggtgaaaccccatctctactaaaaatacaaaaattagccaggcatggtggcgcatgcctgtaatcccagctattcgggaggctgaggcaggagaattgctcgaacccaggaggcagagattgcagtgagccgagatcgtgccactgcactccagcctgggcgacagagtgagactccatcttaaaaaaaaaaaacaaaacaaagccaaaaaaaccaagtagaactgaaaatgtcacagtccctgcgctctacaagttctaattcttttaaaattgttgcgtttttttcttttcattttccaaaaatatgtcagggtaacttgccaggtgactttcaggtgattggggaggcctaaagcacattcttttctcatgagcatggaataaacttttgtattaatacttctttctacagttgtccctcacattactgatgctgtccaggagtgggttatgaatcaagccaaggtgccggtggatggtaataaggaagagccccaaatatgcgttattgaggcaagcatagaactttctttataaaattatatcctgctgggtctttgagcatctgatcttcatttatttgacaaatacttacacacgccctcctgagtgctggacactgggctaggaggtggggtcacagcaagaaacaacatagatggcttctgtctttgtggtcacaagtgagtgggcaagattggcattagacagacaatcacacctactcctgggtggacgtgcagtgatctgcttgtggagactgatcagctgctgataaagtcaatgtgagggcctcttctgtgccggggcctgggatgggcacagtctctgaccttggggagcttgcagacaaccctgtctacacacaacagactgcattctagtgcatactatttgaaaagtatttccgaagtgctttggaagtgtaaagagacactgggttagggaagtcagatggtagcggtgataagtgattagtatcagctgtttaaagaaagaagctagtggctgcgcgaggtggctcatgcctgcaattccggcattttcagatgccagggtgggaggattgcttgagtccatgagtttgagacagcctgggcaacatggcgaaaacccgtctctacagagactacaaagattagctaggcatgttggtacgcacctgtagtcccagctacttgagaaggtgagatgggaggatcttttgagcccgggaggttgaggctgcagagagcagtgattgcaccagcacttcagcctgggtgatggagccagaccctgtcttaatttaaaaaaaaaaaaaaaaaaaaaaaaaagtcgtatttgaacttgccacttgtttacttccttcaccttgttcccttcctctccacgtgcagaatgacaataacatccatatcctcctcctctaaatgtcagttggcttaattgccgggcgaaagagcagaataatgaccaatttggttcttagagtcaggctgcctcagtttgtatttctgcagtgacccctgagccacgtatagctcagtgattaagagtctggaggcaaactgtctgggtttgtagcctagcaaggtcacttatggggaggagggggtgaccttgggcaagtttgctcaacctctctgtgcctctttaactcatttaactcatttgtaactcattgttttgaagattaaataagtctctacacttagtgcttagaatggtgtcacagatatagtaagtgcttaaaaattattagctattattaagatgcctgtatgacttttggaaaattctcacagtttcaacgtcctcatttgtaataatgtaataatataatattataataataagataataacaggattggggattaaatgcaatgtatcagagcactttgcaatgtctggcatttaggaagtgctcagtgaacataagttagctattattattgtcatcaatgtaagtgttagcagatatcatgatatgtagaagatccattttgttaatagtagaactgataaagttactggctatttattttttatagatagggtctcgctatgttgcctcgggctggagtgcagtagctatccacaggtgcgatcaaagcccactgcagcctcaaacttctgggctcaaccaatcatcttgcctcagcctcccaagtagctgggactacagtgtaccaccactatgcctggcaaatttttaattttatttcttattctacccttgaattgacttgtcttcacaatgattaatttagcacttaatatgtactagccctgatgatagctgctaaggatgtgaggttgagtgtgatctgactcctgctctccaggagctcattggctggattttaaatttcatggaaacagggaaactgacaaacagaaccccttctccgttataaccctgatgtttatatttgcttattggatactagtggtcaaccatcctctttggttgattgtaagttgtgttcaacagttgtgtctgtgcaccatttaagcttttgaagaaggactgccaaagctgatttttagttttaatcatagaggagctgttgaaatgtcttcaaagccatttttatgagtgagacctcaacttctcataccagtggagctgacaggttttatttatattagtacgagttatcttggcatgaacctgaaataatttatgcttgtcttaaaggaataacagttttctttcttcttgtttattttccaaaaaagaagactcagccaagtgtggtggtgcaggtctgtagtcccagctacttgggaggctgaggcaggaggatcatttatacccaggagtttgaggccgcagtgagccatgatctcactactgcactccagcctgggtggcagagcgagactctgtctttaaaaaaaatttaaaaagggccgggtgtggtggctcacgcctgtaatcccagcactttgggaggctgaggcgggtggatcacgaggtcaggagatcgaggccatcctgtctaacacggtgaaaccccgtctctactaaaaatacaaaaaattagccgggcgtggtggtgggcgcctatagtcccagctactcaggaggctgaggcaggagaatggcgtgcacccaggaggcggagcttgcagtgagccgacatcgcgccattgcactccagcctgggcaacagagcgagactccatctcaaaaataaataaataaataaataaaaataaaaaaagaaaaagaaaaaagactttcattaaagacaaaggcaaaaacaactttgcacatctcataaatttgctgctgcttccatttcagcataaagtattgttataggtgatattttcccttttatctggggcaacagttaacttcaaactattccagtagtaatattgaaggtttctgaacacgataatgtgggtgacctagaggtatggtaatgggaacttctgaattagcagggagactgtagtaccgctgctgaccacgtgagggcagaagctgataatgtttgaagttggcctccttttggcattcactattattgaccccccagagaatccccatcaaaacacaagatggaagcacacggtttagtttaagtgcagacctctggttttccttagaaaaaataaatgattttcaaaaattagattttggtgccttgtatttagtgggtacttacactcacttcacccctgccaagttcctgattgcatgtgatgttttcatttcgttgagttgttgttgttgttgttgttgttttttaaagagacagtgtcttactctgttccctaggctggagtgcagtggtatgatcatgactcactgcagcctggacttctccaggctcaagcgatcctcccacctcagcctcctgagtggctgggaccataggcgccgtgccgccatgcccagctaattttttatgtttttgtggaggcaaggtctcactttgttgcccatgctggtctcaaactcctgtgctcaagtgatacacctgcctcccaaagtgttgggattacaggtgtgagccactgcacccagccctggctttggttctgctgtaattttggtaacaggtactagaacactgttccttagggcttatattgaatttcaggacctttctgtcctggcccgactactaaactaaacctccagtgctgcatgcagggtactgggctcatgccctcatggggcttacagtctagtggggtagagagccaggaaacaaagacggaaatgaaatagaggcaacttgtgctgaattcctaggatgggtacagtgctgtgacaagggctagtgggatataggctgctttaggtggggggtcagagtctgccctccaaggagggtcagagtccgccctccaaggaggatgcatctctcttggactggaggataaagaggttgctgtagatgaagaaggagggtaggagggcttaaggagcaggaaggaagagcatggagtacccaagaggccagcggggaggggaccagatggcattggagactcagtgcaagggccaggtcctgagagccttttgttggctgcattaaggagatttgatgctagttttttgtttttgtttttgttttgagatggagtctcgctctgtcgcccaggctggagtgcaacggtgtgatctcgactcactgcaacctctgcctcctgggttcaagcgattctcctgcctcagcctcccgagtagctgggactacaggtgtgccccaccacgtccagctaatttttgtatttttagtagagacagggtttcaccatgttggccaggatggtcccgatctcctgacctgtgatccgcccgcctcggcctcccaaagtgctgggattacaagcatgagccactgcgcctggccttattgttagttttaatgaagcaatgggctactgaagagtatacacgtggagaaatcttttttgaagttttattttttatttttatattttttcagagaaagggtctcgctctgtcatctaggctggaatgcagtgggatgatcatgactcactgcagccttgacctcctgggctcaagtgatcctcctgccttggcctcccaaagcgctgggatcataggtgtgagccgccatacccagccacaatttagtgattttgaacgtatttataaacctctgtgtaaccatcaaactttagttctcatgctcggtttattaagaactctttttattagcttgtgtactgtgggagatgtgtggtcatttgtgtctttttttgtttgttttccattcccagctgggaggcaccattggagacatcgaaggaatgccgtttgtggaggcgtttagacaattccagtttaaggcgaaaagagagaatttctgtaatatccacgttagccttgtcccacaggtgggctttccagataagtatgtggacagcaactttgataagttttcctatgatattctatgtgtcctgcatttgaaagtggggcaccattaatcatccataggagctagtgtccagtgtgctgacgggaccccattttttttcagctcagtgctaccggagaacaaaaaaccaaacccacccaaaacagcgtccgcgcactgaggggtttaggcctgtctccagatctggtgagttgaggacagtgggtaagtctatcctgaaggtctctgggagcaggaccttcacttcttttttttttttttttttaatttgagacggagtcttgctctgtcacccaggctggagtgcagtggtgcagtcttggctcattgcaacctccgcctcctgggttcaagcgattctcctgtctcagcctccagagtatctggactacaggcacatgccaccacacctggataattttggtatttttagtagagacagagttttgtcatgttggctaggctggtcttgaattcctgacctcaggtgatccgcccgcctcagcctcccaaagtgcttgggattacagccaagagccaccatgcctggctgcccttcacttctttatctttatcatcatctaagtcctttctcattctcaaacggctcctgtgacaatgaggtttttctatctgggagccggaaaaggcttattcccttagcctcaagtgttgcttcaatctgttcttccctaggctctcatttgatgggccacattgatagttgggcaagtgtgatgtcctgtcatttatatgattcctggattctttagaatgaaggtgaaaccttgggattttcctgtgaccctgctatcaatgataaccctgtgatgggttatcactgctctttttttctttttgagacggggtctggctctgttgcccaggctggagtacagtggtgtgatcttggctcactgcaacctctgcctcctgggctgaagtgattctcccacctcagcctcttgagtagctgatactagaggtgcacgctaccacagcgcactaatttttgtgtggtgtgtgtgtgtgtgtgtgtgtgtgtttgtagagacagggttttgctatgttactgaggctggtctcgaactcctgggttcaaccaatcctcctgccttggcctcctaaagtgctgggattgcaccacgcccagtccgctgctcttatttttagtctaaacagtgatgtgtccttatagcaggtgatccagtcatcaccagtagtctctgtcagaggttgacaaataacagcccacaacttgcttgcctgtttttgtaagtaaagttttattggcatgcagtcacacccattcatttacatattgtctgtagctgctttcacactgcacctcaattgaggatcaggacagtgactgtgtcacctgcaaacctaaaatatttcccatctggcccttttgagaaaaagtttgttaaccccgatctagctcttttcttgtagttaatgaagcaacacttgtgagcctggactctgttcaccagagacgtctcgatgtttcgagttcttactgatacacttatgctgaatttgattatacttatattagtgctcagaccaatttctaatagtccagtggaatgtccaaagtgaacaagtacatacttggccaagtttcttgtaaaaagaaatgaatgtggcatcctgctgaaagtgaatcctgtttgctgaagcataactggctttgacagattgtctgccgaagttcaacgcccattgagatggccgtgaaggagaagatttctatgttttgtcacgtgaaccctgaacaggttggtgctgctctttagattttattgtctggcaggcacttctgctgatgccagtgttttgtacctcttcaatgatcatattacttttcacggcatttatgcaagcactggggaaccctgatccaaccatgattccctagcccttaagtgagataggatgcatgtttctttgcatgatcactcaacttatgtcacaaaaccagggtgggctttcttttcttgagacagagtgtcactctgtcacccaggctggagtgcagtggcatgatctcagctcaccgcaacctctgcctcctgggttcaagcaattctcttattttagcctcctgagcagctgagattataggcatgcgccaccacgcctggctaatttttttgtatttttagtagagatggggttttgccatgttggccaggctggtctcgaactcctgacctcagatgatccgcccgcctcagcctcccatagtgctgggattacaggcgtgagccatcgtgcccagtaccagggtgggtgtttaactcacagtcaaacctctagagagagaaccacatgaagcctacttatcatctctttatcttgtgtttccttctggaacacttactgctttcactcatttctcctctctacctgtggcagcttaagtcaccccaaacacacgagcacgttgacattcgcactagctcttctgactccatcagtgggctcagttgacttcattggtacagaaactgtactgtgatttgggcttaggttctctgctctgtagggctttccaccttggtattctgataattcgcttttcttttttctttccttctctcatctctgtctcttgattccaataaggcttggttataagggattggagttacctatagtttaaagagagtgatataaatggtgctcaggaaaagggtgaggtttggcagaaatcttttcttcagattataactctgggttctctgaagtctaaaaatgatcaaattgaattttggcatcttggaaaatagtctgatggagagccccctgcctgatgcctcagagtcattgccgaagtctgaactactttgaaaaatgtgatggcagattgaagggacacttctgcatctgtatgttgatatgttgtcatgccattttgtttgcgtccaatctttttttttttttgagacagagtttcactattgtcacccaggctggaatgcagtggtgcactcttggctcagtgcaacctctgcctcctgggttcaagcgattctcctgcctcagcctcctgagtagctgggattataggtgtgtgtcaccatgcctggctaatttttgtatttttagtagagatggggtttcaccatgttggccaggctggtcttgaactcctgacctcagatgatccgcctgcctcagcctccaaaagtgctggaattacaggcgtgagccaccacacctgacctgtccaatcgttttgtgtacacttcttttttttttttgagatacagtcttgctctgtcacccaggctggtatgcaatggtgcgatctcgactcactgcaacctccgcctcctgggttccagcgattctcctgcgtcagcctcttgagttgctgggattataggcacatgtcaccatgcccagctaatttttgcatttttaatacaggtggggtttcaccatgttggtcaggctggtctcgaactcctgacatcaggtgatctgcccgcctcggcctcccatagtgctgggattagttttctaattaaatgaagctaaccttgtgcaaattctgatgctagctttggttgctgggtttttgtgtgtgcgtgtgtgtgtgttatatcagtgtaaataaactgccagtctctgctgaattttgtttcattcttgtggtggcatatttgaatagatccatctaagtatggtgatttctcatcgccacttaggtcatatgtatccatgatgtttcttccacataccgagttcctgtgcttttagaggaacaaagcattgtgaaatattttaaggagagattgcacctgcccatcggtgattctgcaagtaatttgctttttaagtggagaaatatggctgacaggtaagcgaaaggaattacttgtataatctttaataatttttgagtttgggggtagaactaagacctacttgaaagggtaagcgtgtgtatttggcattttgcgtgtgcacattttggtctggatatgtctaaagatggagcatactgttgcggtgctttgctgtattatttgaagatttctggagcctttgattttgttatacataaaccaaagtgaattaaaggaattcgaattctggaaggaatgtttttttagctctggaaggattctgatttatttgatttatttgctagttcattttttagtttctgaatatttaaaatttttttttgtttgttttcttttttcttttttgagagtcttgctctgtcacccaggcgggagtgcagtggcacgatctcggctcactgcaacctccacctcctgggctcaagtcatcctcccacttcagcctcctgagtagctgagactagaggcacacaccaccacacccggctaatatatatttttttttttttgtagagacgggatttttctatgttacccacactggtcttgaactcctgggctcaagtgatctgcccaccttggcctcccaaagtgctgggattataggcatgagccaccatgcctggccttaaacagttttaaacttcacaggttttttgttttgttttgttttgcttgtttttaagatttggctaacttttcctaaagaaaatcattttggatgggaacttttggctatgctagttttgtttcatcctgcattcattaactgttcagcataattattaaaactcctgatggattctaactttcagacaagtatattaatttaagcaaagtttctctattttgaagttatatgaaaattaagctgtgtgcagtggcacttacctgtagtctcagctacttggaaggctgaggtgagaggatcacttgagcccaggagttggaggccagcctgagcaacatagcgagaccctgtatcttaaaaaaaaaaaaaaagggaaattaagtccctgtcacttgttttctttttttttgagatggagtgtcactgtgtcgcccaggctggagtgcagtggtgcgatcttggctcactacaacctctgcctcctgggttcacgccattctcctgcctcagcctcctgagtagctgggattacaggcgcccgccaccatgcccagctaattttttgtgtttttagtagagacgggggtttcaccatgtttgccaggctggtctcgaacttctgacctcaggcgattcgcctgtctaggcctcccaaagtgctggggttacaggtgtgagccaccgcgcccggccctgttttcttttactaaatgtagttgagatgggacttcttgggcagcttaggtgagcgccagtaggtgcagctgttacgtatgtaggttctggactcaaatcctggcctcttctcttaccagctgtgtgagtttgggtgattacttaacctatctaggctttttttcccttctgtatataataaggggataccagtgcctacctagtggcaattatgagaggaaaccttaaagacttaacattgagtcacgtactataataagtatcggttgctgatgttggtaaccataattaaaatgatggtgacaaaattactgacccttggtagatgactaatcagattgaggctctcttgctctttcatttacaattttaaaaaatgctttagattttctggggcaagtggaatcaggaaggaagagcagtttctgagcttagattctctaaaacccttgctctctagagtgcttaaagtgccagtcatttcacaggaattttctaagtagcttggggctgatacactttaagcactagaagttttaatattttaactctttttattggaaatagctctaaattatactctatgcgtttatgctttttttctttttcttttctttcttttttttttttttttttttgacacagggtgttgctctgttgcccaggctggagtgcagtggtgcaatctcagctcactgcagcctcgacctcctgggctcaagcgatcctcctgcctcagcgtccccagtagctgggaccacaggtgcgctacaccacggccaactaatttttgtatttttagtagagacggggttttgccatcttgctcaagtgatcttcctgcctcggcctcccaaagtgttgggattacaggaatgagccatatgcctggcgcttctgtgctttttaaagccacatgtttggtctttgtattagcttcctgggggctgccataacaatgaccactaactgggcagcttaaaaaaacacaacaggaatttattctctcacagtcctggaggtcagaagtgcaaaatcaatgcatccacagggttggttccttctagaggctctgcaggagattctctgccacaccccttctcctggcttctggtggctgccagcaatcagtggtgttccttggcttgtggccacatcactccaatcttgtcctccatcttttatttccttatttatttttttttttttgagatggagtctcactctgtcacccaggctggagtgcagtggtgcaaccagggcttaatgcaaccttgaacttctgggctcaagtgatcctcctgcctcagcctcccaggtagctgggactacaggtgcatgccaccatgcttggctaatttttgtgttttttatagagacagggtttcaccatgttgcccagcctggtctcaaactcctgagctcaagcaatccacctggtttagcctcctaacgtgttgggattaaaggcgtgagccaccatgcccagcctttggcctccaggcctccatcttcacatcaccttctcacttgtgtcttcttcccttctcttcttttgtaaggatgcttgtcattggatgtaaggcaggccctaatccaggatgatctcagctggagagccttacttatgtctgcaaagaccctttttccaaacaaggtcacattcacaggttttggggacaaatttctttgggggggggccaccattcaactcactacagcctttttatttttaatttttatgggtacatagtaggtgtatatatttgtagggtacatgagatatttggtacaggcatataatgcattataatcacatcagggtaaatggagtatccatcacctcaagcctttatcctttctttgcaatacaaacaatccaagtatactcttttatttatttaagaatgcacaataaattgttgacaattttcaagcaaggagatattgtgcatgggtgcctctgcagcactgggcctccctctgcatcacattggtggtgacattgttaattgatgcgaagtgtccattctttagctttggtcctctcagtatagcctgtagagaggtgcaaggagccaaacggaggccaaaggaacagcctctatcatggaggcccagtgctgctcagaggccaggggtccctgattaaacagggacagcttgcctgggacccgaagtcaaggtgggcacaattctccacctcctcctattcattgtcttttttttttttttttttttttttggagacagagtctcgctgtgtcgcccaggctggagtgcagtggtgcgatctcagctcactgcaagctctgcctcctgggttcatgccattctcctgcctcagcctcccgagtagctgggactacaggcgcccaccaccacgcccggctaatttttttttttttgtatttttttagtagagatggggtttcaccatgttagccaggacgatcttgatctcctgacatcgtaatccgcccacctcggcctcccaaactgctgggattacaggcatgagccaccacacccagccctcttcatctctcttgagacccgactcttgggggtggccctgcaaagaggactcccctccccctcccacagcagcttgaagtagtatcacatgcttgcctcacattcggtgatggctgatggctgagtggggcacatgagggagaccttggttgctctcggaagtacaggtccaagggggaatgagagctccctggtaggtgtgacccagtggactcacctgtaccacctgctgcccagtgactcctcccctgggaagaccagctgtgagtgagccgtaggagtaacctgtgatactgaccccagtgctgcttccttccgggggcagagctgatgttgtctcttctgtctatggaggagggagaagggggtgaagccaaatctgctgttctcaaatgcggctctgcctgcctgcctctgacatcatctctactacttggtgtgctgtcatcctgctttctgttacccgcatcctcttttttttttggagaagaagtctggctctgtcgcccaggctggagtgcagtggcatgatctcggttcactgcaacccctgcctcctggattcaagtgattctccttcctcagtctcctgagtagctggaactacaggcgtgcaccaccatgccagcctaatttttgtatttttagtagagacagggtttcaccgtgttggccaggctggtctggaactcctgatctcaagtgatctgccggccttggcctcccaaagtgttgggattacaggcatgagtcaccacgcccggcccgttacctgcatactttatggagaggtggtgtgagatacagacagctgtgaaacctccagagcaacataaaataaagtagtgagttcaagggttagcagcttgaactattttagtcaccttttagtgaccttttatcagctattttagtcatctttctagaaagttaccttccctgtcagttttgacttcttagcttcttgtgcattattcccacacatagcctgtttgtgatctagtttctcttgtactctttacagatatgtgttctttttgtttttgtttttttttttttttttttggagacagagtctcgctctgtggcctaggctggagtgcagtggtgcgatctcggctcactgcaacctctgcctcccgggttcaagtgattctcctgcctcagcctcctgagtagctgggattacaggtgcgtaccaccacgcccagctaatttttgtatttttagtagagacgaggtttcaccatgttggccaggatggtctcgaactcctgacctcaggtgatccacctgccttggcctctcagagtgctgggattacaggtgtgggccaccgtgcccggccactctttgcagatgttgatattcaagagagatattcgtcatcatggtaacatttttctaaggtgtttggggaagggtttgcttcaaagccctaaaacaccttcagccccaagatgacatttccacgtacctaataccaaaccagatatttttcatgttctttgaacagatttcctgacaaaagcaacactaaaaattgtgtctctaatggtaaaatgtgatcgagtgtcttctgtagaatggaatttttctcataaaaatgatctaaatggctagtaatattttaaatcgttctctcagcaccattcttcaggcatgccatgaataaccagacttttgtgggtcagctgggaatgtaaccattttaaatgtagacactttgaatgcattttcttacacaatgtcaccttacaaagttaatattggaatgtttcctactgacacgcagaatgcattttttttatacaatgtcaccttattaaccaatgtaagaatagctcatgtttatgagattgggatagcttttcaatttttacttttaatgcttttaactttttctctgatatacttgaatttttatctgtatctgcttgtgtaaaacaacgttgggatttctgtttttgttttatgagacagtgtctcactgtgtcgcccaggctggagtgcagtggtgtgatcatagctcactgcagccttggtctcctgggctcaagtgatcctccaacctcagcctcctgagtagctgggattgtaggcatgccccaccacgcctggctaatttttgtatttttttgtagagacggggtctaactatgttgcccagtctggtctcaaactcctgggcttcagtgattctctcgcctcagcctcctgagtagctaggactacagctgctcccgaggatttaaaaagtgccttggagtaagagcagcagctgccattgttctgtttgtgatgttctgttatgtgcatataacctttgagtttgttttctttcccaggtatgaaaggttacagaaaatatgctccatagccctggttggcaaatacaccaagctcagagactgctacgcctctgtgttcaaagccctggaacactcagccctggccatcaaccacaagttgaatctgatggtgagtcctggcctggtcttttggctatctcagtaattcatgccaatagcacatgttccagaggggcaagttttgttaaagggtccctgagatcacctgcaggacttacgattcaccagaagaactcacaggactcatcatatagttatactcatagctaagatttattatagccagacaatgcaaagcaaaatcagccaaggaaaagtcgtgcagggtgaagtctaggagtaaccaggcgcaagcttctaagtgctctcccctggtagagtccagtgagttgtgataatacatgcaaactgccatttactaaggaagctcattgaagacttgaagcccaaggtttttactgggggctggtcacgtaggcaccctcttcttagcacttcccaaaatgccagcctcccagaaggaaagcatgcagcagaaaccatgttgtctgtacagacactttcagcacagtgagcttctcctatcagttcttggaatgatgggaaccctcccaaaatcagagtttccagaagccagtcaagtctcaatcttgtagcaggcctttccaagggcagcagccaggcttgctgtgtaaacggttttcttttttccttttttgagacacagtctccctctgccgcccaggttggtgtgcagtggcatgatctcggcccaccgcaacctctgtcttcaccgttccagcaattcttgtgcctcagcctcctgagtatctgggattacagactcccgccaccatgcccagctaatttttgtatttttaatagagacggggtttcaccacgttggccaggctggtctcgaactcctgatctcaggtgatctgcccgtcttggcctctcaaagtgctgggattactggcatgagccactgtgcctggcctgtgtaagctgttttctacatgtaggtttaaggcacatttctgaaagtaggctttgcacattcagatgaatgagcatgcttgtcatgctcgtttaagtacgtcgtaattgcctaacaggaaaataataggacattttttccctttagcattggaatggaatctagattttttaaaatactatattcccctctctaacatggaggaatgatagctagcaaacagtgattatttgttttggaaactcagtattgtggaataacagaggcgtagttatcttatatagcttgagtatattcttccatataagaacggaagtagtacatgtttagagtaaaacatttaaacaaagcataagccaggcgaagtagttcacgcctgtaatcccagccctttgggaggctgagccaggtgggttgcttgagctcaggagttgaagaccagcctgggcaacaatgggagacctcatctctataaaaaaaacttaaaaagttagccgggtgtggtggcatgcgcctgtagtctcagctaattgggaggctgaggcaggaagatcacttgagcccaggagtttgatactgcggtgagctataattgcgccactgcactccagcctgggtgacagattgagaccctgtctccaaaaaacaaaacaaaacaaaataaagcataaatctaaaatgcagaaagcagattcctcctccctgaaatcccacttgttaccagttggatacgtatatttatatatctatctcacatttatatttaatgatattcagtatgagtatatcattgtttaagcaagtcttatcatcttgacttaaatggcaaaaactttgtataatgagtaaaaagatccatttatatgttaaagaaatttaatggcttccactttgacactagcttaggagaactagctgctgtttctctctcctctttttagcctccttctttcctaatcactttttaaaaattttattttattattttttaattaattaattagttaattactttttagatggagttttgctcttgttgcccaggctggagtacagtggtgccatctcagctcactgcaacctctgccttctgggttcaagtgattctcctgccttagccacccgaatagctgggattacaggcatgtgccaccacgcccagctaatttttgtatttttagtagagatggagtttcttcatgttggccaggctggtctcgaactcctgacctcaggtgatccacctgccttggcctcccaaagtgttgggattacaagcgtgagccatcgtgcctggcctattttttaatttttatagagacggggtctcgctatgttgcccaggctggtctcgaactgctcaaacaattcctcctgccttggcctcctaaagtgctaggattacaggcgtgagccaccatgaccagcccctaatcactttttacttttggctttctaaggaatagtttacttcccattcctcccactccttcaagtcgcccgccccattatgtaaaaaaaagaaaatggcaatggaaaaattgccatgacatatacattttataaagcctttagaaatttgtatcttaaagtttatttgaatagtcttttttttttcttttcttttctttttcttttttttttttttgagacagggtctcgccctttctcctagggtggagtgcagtggtgcgatcttggctcactgcaacctccacctccggggttcaagcaattcttgtgccttagcctcctgagtagctgggattacaggtgcccgccaccacacctaattttgttatttttagtagagacagggttttgtcatgttggccaggctggtcttaaactcctggccttaagtgatccacctgcctcggcctcccaaagtgctgggattatagacgtgagccactgtgcttggccaggagagtcatttttacagaagaaatactaaactaatatagatagagagggactgttatatacataagaattggtgcacatgatgcttcatctgataggattcattgacattagcttctcctaagtactgtttgaatcctggccttgtcatcttccttctaagattgggctgcatctgtctatctctcctggtttgctgcagctgcagcggcttccgggctggtttccagctgccagtcttccctgcctttgccacactctaccagagtgatcattgtaaaatctttctcggttctctctgttcctgtcgtccctttacttaagatctttcagtggtgtctcagtctgttcaggctgctgtaacaaagtaccatagaccaggtggcttacaaacaactgccatttctctctcacagttctggaggctggaagtccaagattagggtgccagcatgtggccgggttctggtgagggccctcttttgggtgcagaggaccaacctctggttatatccccatgtgcggaaggggtgagggaggtctatggggccttttttataggggcactaatcctattcctatgtgctctgccttcttgacctaatcatccctcaaagaccccacctacctcctaataccattcctttgggagttgggatttcaacataggaattttgggggaacacagacattcaaaccattgcaattggcttcaagtgtcaagtctgtgtcatggcttctcagcctcgtcccttgccttcctccaaccaatcaggtctgtcctctcgctgggtggggccttttttgagggtcccagagtggctaccactttctctctttttcctctgaggtttcatataagtggttcctttgctggagatttcttttttttttatttatttttatttttttattttttgagacggactctcactctgttgaccagacttgagtgcagtggcacaatctaagctcactgcaacctctgcctcctgggttcatgtgattcttctgcctcagcctcccgagtagctgagattacaggcacctgccaccatgcctggctaatttttatatttttagtagagacggggttttgccacgttggccaggctggtcttgaattcctaaccttagatgatctgcccacctcggcctcccaaagtgctgggattacaggcatgagccaatgcgcccggcctgctggagatttcatacccttctcccctcctctctttgtctcctgctgcctcccatcacacacgtgcttatcttgcttctgctctcctctcggctggcttcttgaacattacctccccagagctcttccttgacgtcaatccttcctgtctttcctccagtgttcagttctagtgacgtcctagttgctttttttttaaatttttttttgagacagtgtctcactctgtcactcaggctggaatgcagtgttacaatcagggatcattgcagcccggacctcccaggctcaaaggatcctcccacctcagcttcccaagtagctggggctacaggcacgtgccaccccacgcggttgaccccaagttacttctgcatcgttctcttctttgtctgtcatagccattatcacagtatagtgtggatgcccgtttatctggttttgtaatctttctgaaagattataagagccgcaaaacagagactgtttttctatccctagtgcccagtacagtgtttgcataataagtaattattgaataatgtgtcatagtattagatggctgcagtatttttgagtgtttatttttcttaaatactccttttatctgttggatgttttttagtacatagactccattgatctggagaagatcactgaaaccgaggaccctgtgaaatttcatgaagcttggcagaagctatgcaaagctgagtgagtaccagggcccacgcacaccagttaggataggaccattgtactttttctgtaatgattcagtttaccctaattgctaattttcatgcattttgaaaggtagtttggagtacttgtggtctttgcaggtgattgttccacgatcatactgcgttgatttgaaatgtgccatgttaatgctggtggcatgtgcatagaaatggttttatttggggaggatggggatactgtgggaaagtgtgttgattctcctgaaggatgcagagggaaagtgtgttgattctcctggaagatgcagagatgaatcttacatatgcaaagttaaagtacaagaatgacagctttttttttctctctctttttacaaagtgaaagcaagtttattaggaaagtaaaggaattaaagaatggctactccacaagcagagcagccctgagggctgctggttgccccttttatggttatttcttggttacatgctaaagaagggatgaattatacgtgcctcccccttttagaccttatagggtaacttcctgatgttgccatggcatttgtaaactgtcatggcactggtgggagtgtagcagtgaggatgaccagaggtcactctcattgccatcttggttttggtggcttttagctggcttctttactgcaacctgttttatcagcaaagtctttatgacctgtatcttttgctgacctcctatctcatcctgtgacttagaatgcctaactatctgggaatgcagtccagtaggtctcagccttattctacccagcccctattcaagatggagttgctgtggttcaatatttcccctctcccttttataggagaactcttaatactaagggttgcagagggacaaagctccatcttctgtaacttcttcgtgttgaataggggcaatgacattcctccctattagagtctcttgtatttggggtagagaagaggtcagtcagaaagcgtcagatggcgagggccattcataactctgagttccaacaaaaggtgatatctggaagattaataaatgtttagtttaagaaaacattgagtaagcttattctgcattcctacacaaagagtacaatagcaatatattccacaacagtaaagcaaaaaattatcccaagtaaactaaattagaaggctttccatgaactgggcaactgttggaaccaagctgatatgcagttgctagctgatttcaatacatgcccagaattagaatactgatcccaatttttacgttacccatccctcttgttttttttttttttttttccgagacagagtcttgctctgtctcccaggctggagtgcagtggtgcgatctcggctcactgcaacctccgcctcccaggttcaagcaattcttctgcctcagcctcccaagtagctaggattacaggcacgcgctaccatgcctggctgatttttgtattcttagtaaagacgggtttcaccatgttggccaggctggtcttgaactcttgacctcgttatccacccgccttggcctcccaaagtgctgggattacaggtgtgagccaccacgcccagccctgctcttgtttttttctgagctgcagtcacagatcactgattgtttcacaggaataagcagggtcagtctaaattgcagaaaaaaacttcaaaaacaaccaataagactagaattcataataataacagttagaccatagttcttgaaacataattttttctctctccagtttcccattttcactaaagacaaatcatggtaagaacaatttgctttattatacttggcctgattatttgtataaagtgcagcaagaataattatttttcaataggcttttaaaattggctttgacagaaccttattccataaggaatctcagataagaccttttttaaagctgagcccacccatgggtttgtaccctcaaatacctatgaattgggtaaattcctctctttttgaggtcccaagataacttgaggctcctggacctgtcagaaagtgacattctttagttaccacaggtcagaaaccctgtacagggactgtgtagacaaggtatgaggctagttttcccacggggcttgtattggctttacaattcaagttcgattctttacaggaaagcacaccattccagtcaaagccttggtaatataaccagtttctccctccaattgtgtcctgttgcaaaataaaaaagattcttattgcacttatgcaaacaactatattgccataagttaagaatactcacaaattccaaatttcccaattctggacaaatcaggtagagagaaacaaatatgctccaaattttgttcacaggagtatactttactcaattgttacaagctgtatatagctcaaaagaacagttttcttgactccgaaaaataaaacaaaaaggatcagcaacattttaagcaaagtaaaaaatattaattttttattagttcattccatggagctaactcctgttctacttgatagtcatgaacatttcagctctccatgagagtcctgaaagattttcctctattctgctgtcacaatctccaaagttatcagaaacttgcatttaagaacagctgttagagttctatagttgatttttaactaccttctaaagaggaccaaaacaatacaattgtctgtgggtgacaaaatgttttagggcagccactattaaagccacaattgactaggaatttgttacatctgtggcttacaacaattttgcataacaatgataattattaataacatacacgaattcatattagaattatagaagtttcttataattttggaacacatacaataacatatttatacaaatacagcccaaagaaagccaaacaccatttcatatttgacagtgcttttcgtataatttttataccaaatataccaaacttcaccattgcattagtgcattaaattcatgtcaaacccaatttttaataaaaccttatagataaatctatccaattttagtttgaccataaggtaagatttttacaaaccttctataatcctttacaagttttttttttttttttgagacacagtctcttgctctgtcaccgaggctggagtgcagtggtgtaatcttggctcactgcaacctccgcctcatgggtccaagcaattctcctgctccatcctcccgagtagctgggattacaggcacccgccatcatgcctgactaattttttttgcatttttgtagagatggggtttcaccatgttggccaggctggtctcgaactcctgacctcaagtgattcgcccacctcagcctcccaaagtgctgggattacaggcatgagccaccatgcctggctcctttagaagtttttgttaaagagcagatcagcactctaagagaaacctgttgtgcttttatttcaatgttcaatttatggaaaacctgaatacacctttaactttagccaatgtccacacgcataatttctttttttttttttttgagacggagtctcgccttgttgcccaggctggagtgcagtggcgcaatctctgctcactgcaagctctgcctcctgggttcatgtcattctcctgcctcagcctcccgagtagctgggactacaggcgcctgccaccacgcccggctaattttttgtatttttagtagagacggggtttcaccgtgttagccaggatggtctcgatctcctgacctcgtgatctgcccaccttggcctcccaaagtgctgggattacaggtgtgagccaccatgcccggcctgcgtaatttcttttataagattaatccttcacaaaccttctacaacttgctcaaactttcagctttatcttatctaacttaaaataatccgttagctggatgcggtggcttacgcctgtaatcccagcactttgggaggctgaggtgggtggatcacctgaagtcaggagttctagaccagcctgactaacatggtgaaaccccgtctctactaaaaatacaaaattagctaggtgtggtggtgcatacctgtaatcccagctacctgggaggctgaggcaggagaatcgtttgaacccacgaggtgaaggttgcagtgagccaagattgcaccattgcactccagcctgggcaacaagagtgaaacttcgtctgaagacaaaaacaaaacagcaaaaaacaatcctttaaccttttaatctaggcaaaaaaaaaaaaaatccacattttcatgccttcttataatcttttactaaaaacacatttcactttccttatgcaacttgcatgtaaaactgtttcttcagtagtctcaattacagattacactgttaactcttaggaacttttacttttggtgaaaaacctggttagtaagcaattttaattacgtactaggtatggagcctaggacactagataaggtctgaccttttccagcatagctagggggcatggctttcaacttgtccccaagccttacctagaatctaatgctccaaagtaggtaaattgaacaattttcaagagtcaaagcagtttatgaccttaaagcattgagaaaacctaatatctgacctgcctaatttagaccaaatgtctttattttcccaataatctttaaagctgtttttattacccaaagattactaaagttatgtgaactaaaagtcattacaatttttacttttcttacacaatacttgatttaagctttactatttttaaaccaattaaagctttttttttttaacatcacacacacaacacatataaatgcacagacagaaagaagatccagtagttgtaagcacccaaatatcaatcagaaaggcttatcccctaaactaggaattgaaccctgaacccaggtcaccattgtgatgatggagaccaagagaaagtactgccacatggttgcaaggtcaagctcccaaggacatgaaacaagatgagagggaacccttatctagtttttcttcagggacctacagcaaagtttgttattgaccagtttgctggggtggcttgaacagcaggcttacaggggtcctaggcccacattctatcctaagacccctcattatgacagaacaatacagaaagacacacaaagcacaccagattcactgtagcttaagagtagcctcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcatgaacccgggaggcggagcttgcagtgagccgagatcccgccactgcactccagcctgggcgacagagcgagactccgtctcaaaaaaaaaaaaaaaaaaaaaaagagtagcctcacaaatcctttttaccattaatcaaaactttacacaggagacagtgatttttaccattcattcaaccaatttgcacagagagagagagaggccagaagtctgactggtaagaaattcttacccttttgtcggtatgctaggcttctgggttccctttccttgagcagccctagtgacccggctggctgcaccacagccctgggggccaagctgtaacacaaaggaaaattatcttttcctgttctggccagagcaaaatatgtgtgacaaaacatagacattagccactctgcctagcacccaatatcttactggcaaggctcaaacttgcccctggttgggccccatcatcattaatccaacctctgaccaggagtttcaacttgtctctgggcaagatggtcgccttgagtaacagaaaagatacgaaaaggaaaggagataaagggagaaaagcattgcccgcagcattttggggaaggcaaagagctcagggaggccagagaaagacgcacccattgcagtgacactgaaaagttcaggtggccgcttgtcggtcgtgaagggatcttttccaggagtctcatcaactctcaagtttccccttttgaggaggaaaaagctccccatgtcccatggtcctgtgcatgcctagttctgtcacccatagctatcagcaaagagtgcaaggcagaataatccaaagagaatagcaattaacatcccatagtgccaaacctattcttagcagagagggactttactgagagaggcctctaaccccctaaaccttaggaaggactctaaccttcctaagttgtgcctccaacccaaggtcattcaagcatccttgccttttattgagaggagcctttaactctctctgttttaggagagactctaagttgggcctctaacccaatcccatcctttacctgggtatatgcaccccatttacccaaagtcagccaattggtgcacacagacgattttcctttgggtctggggtctcttcagtattgttctttccgtgtttcactagaaagatgttactggaggctgggcatggtggctcacgcctgtaatcccagcactttgggaggctgaggcggtcttattgcctgagctcaggagttcgaggccagcctgggtaacatggtgaaaccccatctctactaaaatacaaaacattagctgggcgtggtggcgtgtgcttgtaatcccagctactcgggaggctgaggcaggagaattgctggaacccgggaggtggaggttggagagggccgagatcgcgccactgcactccaggcagggtgacaagagcaagactctgtctcaaaaaaaaaaaaaaaaaaaaaaaaaagaaaaatgttactggaccccaccacgtactcagtattgtcccttctgtggtcgctagaaagatgttaccagaaacgggtcccaatccagaccccaagagagggttcttggatcttgctcaagaaagaattcagggtgagtccatagagtaaagtgaaagcaagtttattaggaaagtaaggacataaagaatagctgctccattgacagagcagccctttctctcttgatgatattttccacatgtcttagattttaggttttattttgtaagtaattgacagaactcttgggggcagcattgcatcatgaggttagcatgatcctcctgggttttctgttgaactgtgttgctgttgtgtttgcctaggtctgtgaagtcttctagccaagaaattttcatttgccactacttaattagcatttgaaatcttaggctgatttttccaatttaactctttctgatgatgtcagagatcttaacatttttataatagtgttttgaaagaaccttaacctattttcattcagtttcttttcccagtggcattcttaattgaattgggtttctcagttagtatgctctgatgccacaaagacttatcgtaaaatatatattgaggtcagttgtgagaaattgtcacaatttcttcataacattgggaagatttcagaaaaaaagttcagggtgtgaagtcatataattggttctgaaaatagagcttgagcatagtcactagtgattggaccaagcattgcacgaatggctgaatacactagtttaaaaaaaaaatggatagtcaagtttaccctcattttgtattgatttcagtggtattcttgtgcctggaggctttggaatcagaggaacattgggaaaactccaggcgatttcttgggcaaggacaaagaagattccttttctgggtaaaactcatgtttattgaccctaactatgagtttattagatttttgacacctaggaggggtaacactaaaggtttgttatcgtaaaggtgtgaactcggatttgaaagttcaggtgccaaatagtctgctatagggtcaacaaactatattctaaatttggcccacagcctgtttttatgaataaagctttattggaacacagccacaccaatttgtttacatattgtctatggctgcttttgtggtccaacgtcagagtttcagaccctacggcctagaagctttactatctgaaagaggctagaatctttactatgtgaccctttacagaaaacgtttctcatcctaggagaacttgctgctattccagctgggtagcagaggctgggagaaggctccatctgcaactgtgcttaccttctccaattcccacctcagtctccagagtagctgggactacaggtacacaccactgtgcctggctaatttttgtgtgtgtgtgtgtttttttttttttaagagatggagtcttgctatgttgcccagcctggcctcaaactcctgggctcaagcaatctgcccacttcagactcccaaagtgtggggattacaggcttgagcccccgtgcccggccgagttgagcctttttaatgcttttttttcaaattgcgaagtacggcttctgtaccagggaaaccagaggaaatgggaccttgatgcgggagaggcagccctgtagctggggactcaggcaggagggggagtgcagagaggctgtgtttcccactgtgcagtggatggctgggtgggtttatgagcccattggacaggcttttagtgccagcagaccatttatttccccccattacctgctctttgattagcttcttagactctctcctcttaggatccattttcaaaatagaagactggagtagttacctggataccttgttttcttttactggtctaagctcgttgggggccattgtttttttttttgaagtttctgtctaaatgtgggtaatgttcctcagattattttaatagtatggaatggtttgcaggtctttagctttccctctagcatagcatctctttatgtcccagccatatggaactttctgaaatccccctcaccgccacccccaccccccagcactcagctgtttcctgcttattgacttctgttctggcatccctgatatattgattgctcccttctttgtttcccctgtgtacatcttaagtatctatcggaggagcatctgggatgctctttggcatttgtttagtggagagaattggtgaactgcagtgaaggcggagctgggtctgggagcatccctgtggcaacaggcttgggcgacacaggtctgccttccttcatcaccgagcactctgttcaggcccatcgtgtctccttccctgctgcccaccatgctcaagcccactgtggagtctccaacccccaccccccactgctgcttttccttacagtgaaggctatggggctgcctgtgggttagcagcctgacgtcctgtaggcactcaacctctggccaagcctgtgtttatggctgtgaagtcaccatgagaaggagtgggaaatcttagcccaggaaactccctctgagttggggtgttagatgttctctgaaggaatcaggcactgcagcccactaagatgcctcaactcagggacaaatctagaaggtggcagatttgtctcatggactctgcctctttctttccttctttccttccttccttccttccttccttccttccttccttccttcctttccttccttccttccttctttctttctttctctctttctcccttccctcccttccctccccttccttttccttctccttccttccttctttcttccttcttccttccttccttccttccatccttccttcttcccttcttccttccttccctccttcctctctctctttttattttctttttttttgagacagagtctcgctctgtcgcccaggctggagtgcagtggcgcgatctctgctcactgtaagctctgcctcccaggttcacgccactcccctgcctcagcctcccgagtagctgggactacaggcacccaccaccatgcctggctaatttttttttgtatttttttttttttagtagagatggggtttcaccatgttagccaggatggtctcgatctcctgacctcgtgatccgcccaactcagcctcccaaagcgctgggattacaagtgtgagccaccgcacccagctcctccttcctctctttctctctttcttctctttctttccttccttctttctcacccagcctggagcacagtggtgtgatctcagctcactgcaacctctgcctcccgggctcaagtaattctcctgcctcagcctcccaagtagctgggactataggtgcatgccaccacacctggctaatttttgtatttttagtagaggctggtttcaccatgttggccaggctggtctcgaactcctgacctcaagtaatctgctcactttggctttccaaagtgctgagattgcaggcttgagccattgcgcccagttgaccctgcacttttctgacctcatgttccttctttgtcaactttgggacttaggcggcttcatgatagtctaagcccctgccctgctctctgtcagggattcttctgagaggacagcagggagcaaaacaggcagagtcttgctctctgggagtctgcattctagataggggagacaggcagccaacaaatgaacagaaaatgtgaacaaatacaaagtgagttcatttgctttgcatatgtgctttttaaaataggagtttgtcttgggatgcaactagcagtgatagagtttgcaagaaactgccttaacttgaaaggtaagttcgaggtttgctaatgaccatttatttaaaaaattttctctcttcaaatatttttcagcactattggtgaattactgaactcttttcttaatcttcagatgctgattccacagagtttaggccaaatgccccagttcctctggtaagtggcttgtttatctttctgggtccagtcattgtcacttgggtcctggctcttgcctaaattcataaggggctattggctgggcgccatggctcacccctgtaatcccagcactttgggaggtcaaggcgggcggatcacttgaggttaggagttcaagagtagcctggtcaacatggtgaaacccctgtctctactaaaaatacaaaaattagctggctgtggtggcagatgcgtgtaatatcagctactcgggaggctgaggcaggagaattgctggaacccgggaggtggaggttgcagtgagccaagatcatgccaccgcactccagcctcagtgacagagtgagactccttctcaaaaaaaaaaaaaggcgggggggggtctattattattttttctttacagcaccagaacattttaaattacattattcttatattaaattcctttgttcttgatagtccatcttctcagctatgccttaaagacagtcacaatcctggactgatttctctttgtcgcagctttcaagcttaatgtttaggaaaggattaaatcggctgtgacaacaatttataacatctactataaataaatgagctgtcctgtctccagactcatcaccagtctgcctattttccacactggtggtcatctgtctttctaaaacaaaagcgacagtgattctgctgccagtcctcatcttccatcagtttcttttcccttaaaatattcagtccaggattctgggctgggtcccaaagccactgtgctctgtcacctgctgctttgctgattcatcccatggcatcctgattcctcccaggctttgagtttttttcttttttgtgtttttttgaggcaagttctcactctgtcacacaggctggaatgcagtggcatgatcacggctcacggaagcctagacctcccggggtcaaacaatcttcccacctcattttttgattttttttgtagagacaaggtctcactatgttgcccaggctacatgctttgagttttacgtttggacaatctaaactagtttttcagatacagcctgaggttccctatacctgagatgtccacctgcctaaaatccctctccccctggaatctcaataaaagcattgaaaaatttaattaacaacaactcagttaccaacaacttcctattcatctgaggaaacctttcctgacctcttttctttacctgcctctgccttctgcctcatgctactgtgctcaccactaacagagcgagttctgcaagatgatggttggccttcagtcagcctgtttgccagccacccatgcacacccagtcgtgtccctgctgctgggcacctacttctaatggagctcgcgcctcacaatcgcgattggttttttaaacagctttattgagatacaattcatataccacaaaatttagccatttaaactgtataatccggccagatgcggtggctcacgcctgtaatcccaacactttgggaggcctaggcaggtcaatcacttgaggtcaggagttcgagactagactggccaacaagttgaaaccccatctctactaaaaatacaaaaaattagctgggcgtgctggtgcatgcttgtaatcccagctgctagggaggctgacacaggaaaattgcttgaacccaggaggcgttggttgcagtgagctgagatcgtgccattgcactccagcctgggcaacagagtgagactttgtctcaaaaaacaaacaaacaaaaaactgtataatccaatggtttttagcatattcacggatctgtgccactctcattacaagcaattttgggccattttcattactccaaaaagaaaccccacacgccttagctgacacccccaagcctcctatctccaccagccccaggcaaccattagtctaccttctgtcttcatagatttgcctgtttgaatcatttaatataaatggaatcatccaatatgtagccttttgtgactggttgcttttacttaggataatgttttcaaagtctgtctatgttgtaacacgtatcagtactttgtttctttttattgctgattaatatttcattatatggacatgaaacattttatttatccattgatgaacatctgcattgtttctactttttggcattgtgactaacgctgctgtgaacattcatgtgcaagtttttgtgtggacatatgttttcatttcaccaggagtggaatttctgagtcatatggtaattctgtgtttaaccctttgaggagctgtaggactgttttccaaagtggctgcaacattttaatttcctgccagcaatgtatgagggtcctaatttgtccatatccttgtgaacatttgttatttctgtctttttgatgatagccatcctagtggatgtgaagtggtgtctcatcgtggctttgatttgcagttgcctgatggctaaggatgttgagcatcttttcatgtgtttattggccacttgtatgtcttctctggagaaaggtccattcacatcctttgtctattttaaaattagggtatttgtatttttattattgagttgtaacagttctttatatattctagatataagttccttatatataatctgtgctatcggcatttgggaacacatcattctttgttgtatgtgggagctcctgcccactaggtgccagtatcactccctaacccctgcccaactgtgacactaaaagtacctccagatattgtcaaatatctcttgggggcaggggcagaatcgccctggttgagaaccactgatttagagaaatctagttctatttctgtcccctgtagcctgtttaatcccttcccttatggcaagcattcattcttttttttcttggttcatcttcccattttttacatataagtaaagctgtatgtctttgtcatccacttcccttcttagggaaatggtagcatactctacacagttttttcctgccttgcatttttcgcttaacactgtatgctggagatcaccccacggaagcacatagaagcattcttcactctttttttttatagcttgtaactcaaaccataatgaaccataacttaccagccagatggtacttttaagtcttatgctcagaaggcctaataccaatgaagggttccttatgagcctttaatataaacatatttcctgactaatagctgaaatggctgtgccaggaaaactatgggttttcttttctaagatatactttgggataggaagtgattttaccagtaggtgccactgttagatagtgttggcaaggttaattctttgatgattattctttactgggggtgtgtgtacgtgcgttaaaaaatttttacacatggccgggcgcagtggctcatgcctataatcccagcactttgggaggccaaggcgggcagatcacaaggtcaggagatcaagaccatcctggctaacatggtgaaactttgtctctactaaaaacataaagaaattagctgggcgtggtggcacgcgcctgtagtcccagctactcgggaggctgaggcaggagaatggcgtgaacccaggaggcagagcttccagtgagccgagattgcaccactgtactccagcctgggtgacaaagcaagactctgcctcaaaaaaaatgaaaaaaaatttttttttacacagagtaaaaaagttaagccctgcagaaaaaggtacagaactgtctctcctttgcccccacctcacttcggttcccttccccagtggcaactactttgatccatttctttctttctttttttcctttttaaagagatgggctgtctcactatgttgcccaggctggatattcacaggtgtgatcatagcgcactacagcctcgaactcctgagctcaagtgattttcccacctcaacttcccaagtagctgaaactacaggagctcagctgatgcatttctttagttatttcagagatttgtgtgtgtgtttttgtgtgtgtatacccacttagccacacacatatgaatatgtattgcgtttaaaaaaaagatcttggctaggtgcagtgtctcatgcctgtaatccctgcacttttggaggctgaggcgggaggactgcttgagtcttggagtttgagagcagcctgggcaacatagttacaccttgcctctacaataaataaataaaattacctgggcatggtggcatgcacctatagtcctagctactcgggaggctgagggggaggatcacttgagccccaggggttgagctgcagtgagctgtgatcacgccgctgcattccagcctgggtgacagagcgagaccctgtctcaaaacaaaaccaaacaaaacaactttgtagcatgctccagacactgttcccaccttgctttatatactgatcattccacatcaatgtgcagggatgtcttcggtgtgcttgctctgctgtatgctatatggctgcatccttatttatttaaccagtctcatatttagtttgtgtccattattttgctgctttaatttatgctgcaaattagtatccatgtacatatatccttgcacccacgcgcgaacacatctgcagggatagattcctagaaggggagttgctaagtcagaggatgtgtgcattttacattttgatggctcctatacacataagtgagatgagaacaataaaagctaattgctattgaacgtctttatggcctgcaatgtttgttggagaaaaatagccttaagagctagcacttgtatcgatgtgagaagtcttattaaaaaaaaaaaaaaaaagactaaggagatagaatcataaggcagcaagcaccatgaagcctgcagagttacttaagcttgagcaaataacagttactttgtggggactggtcattctggctgttctagctaggaaagtaaacagtttggaaaccaggagccttctatagggaatatttactcctaagatctcttcataggtcatcatgaccctcctttggcatgcatgattagtgctatggctgttgatgaaatcaatagagacactggcatccagaacagttccaagagaaagtgtctgttatacacataaaaagagaaacagatttttccctaagggttaaggtagactctttctgcgtctcagagtgcccaggagagaatgagtaaaatttattttattgtgtcatttctctgcttaatccacaaggtgaaattgaaggctctgggactttgcagaatacttagggttctatagcaactctggttttttgccctgcttcaaagtagtctcagctgccttctagatggtacataaccaagagcgtagctgttgctgacttacattctaaccctatatcaatcacatggctgctgctgacatccttgaccttgaatttggcttcagatctctccagtacatctgtagtgtagttcacagcactttggactttatattttgaatattttcagcttttgaggcatatatatatatatatatatgaatgaacaatctcaatctaatgtgtaggcatgtgaatgtgcttaactctaagcatttcttttctgtttgttgaaaaaggtaactaaaaattctaaatttacataagatattacaccctgaagacagaattcatgttccaccttcaaaagacatcagcacacacatgcacacttggatggtggtatgggaaaggaacagggagaaattcaaagcattttaacgagatgcaaatggatatttgagattttggtatttgatattatttcagttttcattatttatcataggtatgacgtcatttatccctttttgatccaggaattttcagggttaagtgaattttacatctaccatagtagatttgtgaaacagtcacataattaaaagctgatttgggtgaaagttgatttttgttatacatgaagtataattgattaatgcataacattttcctgcctttagttgaagccctgtttaaaatattttcctcatctgtattatttttcaacaacttcatatggagtgcaaattaagaggtgttgaaaacaaaccagatggcccacttagaattatcttttaggcaattttgattactttgaggattttcttgcatttagagtgttgaagtaagcatctcctgactattacaaagatcatatagaaatcacttggaggttagttagggctaaaaatcctttttcccataaaagtagtcattaggaatacagctataggccgggtgtggtggctcacacctgtaatcccagcactttgggaggctgaggccggtggatcgcctgaggtcaggagtttgagaccagcctggccaacgtagtgaaaccccgtctctactaaaaatacaaaaaattagctgagcgtggtagtgggtgcctgtaatcccagctactgggaggctgaggcaggagaatcacttgaacctgggaggtggaggttgcagtgagccaagatcgcgccattgcactccagcctgggcaacaagagcgaaactctgtctcaaaaaaaaaaaaaaatgcagctataatatgggttaaatagctttttacagaccactctgggagcctaatactcctttgatactgtctctgtggggatagtaggtttagagttgacatcagactgttggctgaggtaacttttttctactcagagaaagaaaagttcttgcctgggcacggtggctcacacctgtaatctaagcactttgggcagccaaggtgagaggattgcttaagcccaggagttcaagaccagcctagtcaacatggtgatacctcgtgtctacaaaaaaataaaaaagtaatcctggcactttgggaggctgaggcaggtggatcacgaggtcaggagattgagaccatcctggccaacttggtgaaatcctgtctctactaaaaacaaaaaaattagctgcgcatggtggcacgtgcctgtagtcccagctactcaggaggctgaggcaggggaatcgcttgaacctgggaggtggaggttgcagtgagctgagattgcgtcactgcactccagcctggtgacagagcaagactgtctcaaaaaataataaataaataataaaaaataaattaaaaagttagctgggtgtggtggtgtgtacctgtagtcccagctcctcaggatgctgagatgggaggatcacctgagcctgaggaggtcgaggctacagtgagccatgatcatgccactccactccagcctgggtgacagagtgagaccctgtctaaaaaaagaaagaaagaaagaaagaaaaattctcctgaaagggaacccttgcacactcttggtgggaatctaaattggcattactattacggaaaatagtgtggaggtgcctcaaaaaattaaaaatagaactaccatatgatccacttatcccactactgggtatatatccaaaagatatgaaattattgtgttcaagaggtatctgcactcatgtttgttgcagcattattcatagtagccaagatacagaatcaacctaagtgttcactgatagatgaatagataaagaaaatggaaaatgtggggtgtgtgggagaaatggggagatgttggtcaaagggcacaaacttgcagttataagatgagtaagttctggagatctaatgtacagcatggggaccatagttaataatactgtaatcccagcacttcgggaggctgaaatttgcttagagagtggatcttcattgctctcatcacacacacacaacagtaactacgtgaagtgatgaatatgttagcttgctcgtggtaatcattccacagtgtatacagagatgaaaacatcttgttgtacaccttgaatatatacaattttttttttttgtcattctgtgactcctacaccttcttactccctttgtgaccttgggtggactcagcatggtgaccaaagactttcatgatctgaagtgggtgtgccctcttcattcctcatacttgacattccaccccaaacatggtgtacacattctttaaacagccttgcatttgggcatgatgtgtttgcttgggctgttttctctctttctgaatgcccactgctgcccctttcctgcatgctcccctcaaggttctttctacagagcccagttgaaatgctacttttttgatgaatccttcccctgacctggtcccaaacttactgacttagaatctcagaggtctggaaatttgtgtctctcatggcatcttgtatagtgccttgcccataataagtactttatatatgttggagttgaaatagataatgtatattaactctgcgaggggctaattgatacctagaatgaacataggctaaaatgagaagctagcatgagctagatatcagaactgaacaaaacacacaccacaaataataaaaactcaaaccatagactaacgttggttgggaatgaagatatgaaaaatctcaaataaaatattcgaacatccaatttaacagcattaaagaatgatcatgactgagtagtgtgtttatcctgggaattaaattaacacattatattgattgaacaaaagagagagactgtgtagcgccatacatgctcaacatcgaaacctggtgctcacagtctcataatgaactaggaagacaccagtacttcttaaacaagaagaatatcttccacaaagcagtagccaacagtaaagttcatggtgaaatagtaagggattcttattacaactagcaacaaataaaaaatgtgcaccatcgtgaacaaaacagttgttaaaatgagaccagcaaatgctctctgggaagtgaagctggcgttctccttcctgcctgtagagttatgaatccatacaaccttttgggaaatcagttaggtggtctgtttgacaaaccatacaaatatccataccctctgactcagacatttacttctcagaaattctcctaaggaaatcagaaatgttgacagaaatatgaataggtactcattacatttagaagaattagaaatgacaacaatctactcatcataacatttggaagaatcggaaatgacagcaatctaaatgccccacaatggggaaatagttaagattattatggggtatctgtacagtggaatgtaatgagtcatgagaaatgtttaagagttttaataccatgagaatgctcttgtgttgaattagaatgatacaaattgtatttaaacagtccctcaactgtttataaaaatctcctctgtttcttggtgggttagaaatcacctttttttttttttgagatagagtcttgctctgtcacctaggttggactggagtgcaatagcacaatcttggctcactgcaacctccgcctcccgggctcagataatcctcctgcctcagcctcccgagtaactgggattgtaggtgtgcgccactatgcctggctaatttttgtattttttgtagagacagggtttcaccatgctgcccaggctagtcttgaactattagactcaagcgatccacctgcctcagcctcccaaagtggtgggattacaggcgtgagccactgcgcccggccacctttctatttttctggttaactttctaaatgtttgaaatggcttccaatgaatttcattttattattgggggaaacttccacacttattttctttcttcccaaatctccacaagtatactctcctcccaaaatttagatagttgtatttttctgattattccaaataagagtgctgagaggctaatcacaaagagcagcagccagagatttacaaagtgttctcttactattgaacattttcacttattctttttgataggacacacatccatatggctcagaaatcaaaatgtccaagaatttgtcaagtgaatagtggctctcttattcctgcccccccatctgcccagtcctcttgaagcacgtaaccaatgataatagtttctactgtgcacttgcagagattttccaggaaatttcaagcaccttgccttccaagtcactatataccagctactcatctcgtgcccagttcactttggtcaccctgtccccaccatccctgtgcttacatcaaccggtacttctctctctctgagctcaaacaccccagagagaagcctggccctgcccagccttttatgggtagatgaggtgggagcatgggtacgtgttcctttgcccacctcggagagtcatccagcttctggaaaaatgatagcagccaacttgacagaagaacccagcatacacattcaagttcattagattaaaaaaaaaaaaaaaaaaaaggccgggcatggtggctcatgcctgtaatcccagcactttgggagacgaaggtgggtggattgcttgagcccacgagtttgagaccagcctgggcaacacaggaagacccctgtttctacaaaaagtaaagaaaaaaaattagccagtcatggtggcacatgcctgtagtcccagcttcttgggagactgaggtgggaggatcacttgagcccaggaggtcaagactgcagtgagccctgaaagtgccaatgcactccagcctgggctaccgagcaataccctatctcaaaaacaaaacaacaacaaacaaaaaaacacaaaaaaaccctgaaactaaaaataagtcaaaggcagtactttgcaggcagttattttcagcttgaaggtagagccgtatagcagaatcttggagagggcttatgttgtttgaaacgccttcagtatcatcattttctacactttgaaagtggaaatgggccgggcatggtggctcacgcctgtaatcccagcactttgggaggccgagacgagcggatcacaaggtcaggagatcgagaccatcctggctaacacggtgaaaccctgtctctactaaaaacacaaaaagaaaaattagccgggcgtggtggcgggcacctgtagtcccagctactcgggaggctgaggcaggagaatgccgtgaacccggaaggcagagcttgcagtgagccgagatggcgccactgcactccagcctgggcgacagagcgagacttcgtctcaaaaaaaaaaaaaaaggaaagtggaaatgatcccatatctttctgatgttaactacagaaagtatagtgtggcagtctgggctctagagcgcgaggtaaaaataataaatggcttgaagaacattgttcaaaggcatatcatgtacaattgggtttttgatggggagggcagcagtggggttaaaaaaaatctcatgtctaaagcacagatatgtgcacagcacataaacagatgcacaagacatctctggagttaaaatttcctggggggtggcgattagaaacaagtgtttaacaaagctccttaggaggttgataatggcttaggaaaggttgagagaggccgggtgcgacctgtaatcctagcactttgggaagctgaggcgggtggatcacctgagattgggagtttaagaccagcctggccaacatggtgaaaccccgtctctactaaaaatacaaaaattagctggatgtgggggtgcacacctgtaatcccagctacttaggaggctgaggcaggagagttgcttgagcccgggaagcggaggttgcagtgagccaagatcgtgccactgcactccagcctgggcgacagagcaagactctgtctcaaagaaaaaaaagaaaaaaaaagaaaaagaaaaaaagaaaggttgagagagactgttcaaaggcaatgggacccaatactgatactttgatacttcatgggtgttttgcggaggagagttgcgaggataaagaagaaataaaaatctagcttccggggcactgctgtgaccaggctattagggtcagcttgagccattggtaacttggacaaacttgaacgttaacatttgaactcttatctggtaaggggtagcagaaagttcccttccctccttgaacgttaacatttgaactcttatctggtaaggggtagcagaaagttcccttccctcctctgcacttcttgcctccatattccacactgttgtcacttcaccccctgcatcccctagctggacgcaaaaagtggaacttgaacttgagggctggctgttttctcagaatacaggatgccaagagttgagagggcccaaggtcttcctgtgatcttttatattacacgtcacatgccagtaccatggcgttaggctggtagacccgaggccacccggtcagtgatgagtggggccgcctctaggtcctgtgttccttctgttccccgtcgagggtcattcattaagaaagcacagcgagtgctgggagatagcatgacgtcaactgtctgtttgtgaagtgtttttcttgctcgctagtggatagtgtgagatcagagtggaaattggagatgacctgagcactgaggagttaaggaaggagagcaagcaacagggtgattctggtggaaaagtggagcaagggagttggtttggcatttctggattcttttcaggtctcccacaccatctttgtagttttcggcaggatcacagagctatcttggccctcacattttatttttttatttttatttttattttgttttatttttagacagggtctccctctgtggtccaggctggagtgcagtggcgtgatcatgtctcactgcaaccttgacctcgggggctcaagtgttcttcctgcctcagcctccctctctctctctctctctctctcttttttaaatctatagaattagttgaatcagactaaggttactttcaagtctattatgttatgaggtcagtacttaacaaagtaaggtatgtctaataatttctttattaataataactgaacctcacagccaggttattataattgcaaagaattaaaccagagactttgggggattccacataggataagaccacagcacaggcgctcttcctccagtgctcagggttctattttgttttctccttcactgggatatcttttttactaatacttggaattcttcaaaactaacttctccatctccattcttgtccagttcttgaaagagatcatctagggtgtttggaccctgttttacataaaaaaggatgggagaagggaggggagaaaaaatgaatcagttactgctacacattctcagaaattagaggccttggggtctgtgtgccaagaaggcagctcaggtttccagtgacatgcatctaatagctaacagagagaaaccagctttagctgttgtattgctccgtgtcatagaactggctacctttttgtcctccatatcacacatctgttattttaatacaatgcgtattttaatacagttgttttcttatgcgatcttgggtctttttctttatgcctctaaaaacattcttctgagaagggatctgtgggcttcactggattgcccacggcacacaaacagttgaggacccctgccccaaggttttcctggaagctgggtttgtctcctgctccagggctagggctgacatattacatgaggcagcaggcagggagggctccttctgtaatccttccgaccaccctatgagggagatctactttacaggtggggaaacaggctcagagacaggcagtcacttacttgagtgtccacagctggttaacagaggggttggggtccacacgttgactccagagctcaaccccttaactaaccaccgcccagtttttcccaaacgttgagctatgcaaaatgactttggctcaatggttcccatgctttagcatgcatcagaatcacacgataggcttgctgaccttagtaaatacagactgccagccccacctccagagtttctgattcactaggcctggggtggggcccgagaatctgtacacaaggtcttgctctgtcacccaggctggagtgcagtggcatgatcacagcccactgcagcttccacctcctgggctcaaatgatcctcctgcctcagcctcccgagtagctgggactaaaggcgtgtgccaccacacctggctaattttttaaaagttttaatagagacaaggtcttgctgtgttgttcaagctggagaatctatattttcaacagcttcccaggtggtgccaatgctgctgctctgggaccacacttggagaaccactgcttgagatgtcgtgtgagatcgtgtgcaggctttttgactactggacttcctgcagtgtcttaagtggagttaatttttgtctctaccataaaactctaatcttaaagccattactacttggactttcaggtaggagtctatctgtgcaaaatactacttagaaaaccgattgaaataacagttcagtttgtcagtttcaaattagactatattatatatatatatgtatatataaattgtggtaaaaaacacataacattgaatttacgctcttaatcatttttaagcatacagttcagtagtgctaagtagattcacaattttgtgcagcacatctctatggaagatatattttaacccctaagattcctacaaaaacacttagcactttgctttaattacaagaccaaactgtaagttacttattcagcctttgatttatgaatatgaaacactgttttcctgaagcctttactagattctaaaccatgcatggtgatgatatatgtaaacagagtatggtggaaaaccttagtaatggaaaccttatgggaatataatcaggtacatgttaagtagactttcagaacttaccattagtcttcctacctcgttccagattatgtcttacgtactttttgtaggaaagacataaaatatagaaaaagttacccgtgttaccttttgaaacaacttgtttgagtacatggcctaggctttcctgttagatgattatttttcttccttttagaaaaaataaagggtcttttaaaattttaaattttttcactaacttgttttgctgtttaattaaaaagtccctttttctgctagtgactttaagtgtttttacaagttcttctatatttcaactatgagaaaatgagaaaatatcagattctggggtcattgaattcagcttttttcttttttagtattaaaaacagaagtctttccaattgtcatattggcagaagggacatttctggttaaaatctggagagctggttaaaatatttgaagaaatgttctttcctgaagttagagctaaatagtgactgagtcatacaaaacaattccatagtcacttctgttgtgaagatggtttttaattgcaaaatgacaatgactctctcctttgagtcctctgctcgactaggcctgaccttgggcttccctctctgtccttgtatctgactacccttaatatttgatcacctggcctgccttcagctagaatcctatcaaggcaatttagccagaagctccttatcctggatatttccttggtaattttccatccactggccccccccatcctgctctatggtcataaacccccacttatcctttctggagttgagcccaatctctctccccatggcaagaacacgtttcagtggtccctgtatgggtcgccatggccctcctggagtaagttgccttaccatccttggcaagtgtcctgactcagctttttctttagcaaaaggaaagacagtactgtatattggagtgaggacgatcagctcttctctgtactctgttgccttgaatgcattttgattttgacaactctggggtgattttgatgtgaaactttatggcccaggaaatttagtcctttcttgaaagttgtttagaaatgcacggttgcctcattaacacaaatttaagtgatgaacacaaatgtaaatgcttttgaaatataaatgagtgctgacaaggcaatttgtcagtgggttttcctaacagactgctaagtaagtgttggtcttgttgagggattttacatacacaaatgaagcctgtccaaggccagctaacactattttgcagtcctctttgttttcctaaagcctggcacagaagtactgaatccatgctgaaggccttattgggtttgcttggtgacttgtgggtcttccaggcataacttggcattgcttccatttattatggctagtcctgcagagtcctgtgctgaggctgcaggagggatagaaggcttggcccttgttttctgagagcttgccttctgaaatgtggcctgacttaaggggaagaaaccccacctgcatgtgtcctccctcaagcgacggtccctataaggctctaccggagtcctctcccctccctccctcccctcccaccatcagtcccattaagtgggctctgcggatggccacttactttgagtaaactggggaattcagcctgaatcaatagcttcagttcatcctttgacaactggtctggatcaccttctttggctgcatatttttcaaaaatcctcttcagttcctcaggagactttttagtactcattctggtgtcttataaattgggaagaaaataaacttaccaaaaagctgaagtacagttttgtgctgagggttgtctgcaggattttagtgccattgggccatttccttggcataaatggggaagaataaggaaaagagaatgtcggggtcggaatggcaccagtaactactaacatgtttaaaaaataagcatcttaggccaggcacggtagctcatgcctgtaatcccagcactttgggaggccaaggagggtggatcacttgaagtcaggagttcgagaccatggaagcctggccaacatggtgagaccctgtctctatacaaaaattagccaggcgtggtggtgcgtgcctatagtcccatctacttggaagaccgaggcaggagaatcgcttgaacccgggaggcggaggttgcagtgagtgcgatgccactgcactccagcctgggtgacagagcgagcctccgctgcaaaaaaaaaaaaaaaaaaaaaaagacatcttagatagtatgttaaatgtctgttcttagagtacatctgttaggagatggtccctggagccaaacatttttattagtaattaatgacattctacactttttatgtacctgatctgcactctgcaggctgtggtcttgaagaatacttgaccacagcttctagcttctaagttacagggaatatctccagatggcataaactcaccttctctccagaccattatctttcacaccattctaaaaggaagcagagtattaatgcaaacagaaggagctctaggtagtaccaaaatcacactaacctggttgcccaatagtgaaacagctagaagaatcaaagaggagtttgaagagctgagcagaatcatgacacttttatagtctttacgggcacgccaccctgattatgaaaatttccttttgttggccatttaagggtaattattaatggtttttgaaactcaggcttaagactgcatgaaccccataattaagggcaagatccagtaaaggtccatctcgacagttgcttcatggttcagagtcgtaagcttggatttttttccccctgagattatattttccctccaatgtagaattatatttgctcacagttcacatttcataaagcttagatatagaggattcttttcaatttagttgcatatttaggctttaaaaaataactttcttcatatccagaaaaaataaatgctgccctgtgcggtagctcatgcctgtaatcccagcactttgggaggccgaggcaggaggattgcttgaggtgaggagtttgataccagcctggtcaacacagcaagacatttctactgaaaaatttaaaaaatcagccaggtgtgatggtacatgcctgtagtcccagctactgtagaggctgaggtgggaggattccttaagcctgggaggttgaggcaacagtgagccatgattgtgccactgcactccagcctgggtgacagagtgagatcctgtctgtaaaaaagaaaaaatgctgtcatagaaggacaatattacatagtttaaaaaattacggtatggccattgaagtccttctgatgtctttacatattagcagcttaaatatttgaatacatgaatgaatgaatggaagtattgcttcagaagcaggtttaagaagtggaaagaagatactcagtaatttgtggttttatttggcaaatcaatattgagtaacatggtcattttttcagctctttcattatttgttggtcctgtgtctgctttttatttctcattatccttttccttaccaaatatatttcgtgatcattcgaaaaacttgtgagaacactcgacttactcttgttcagttggaaatacttcaaactttttgtaactgccatgatttaaaattgccaaggagattgatttctactggaaagagttccatgaaataagtaggacatttccaagggacattgatctaatgctgattgtaactcacaggaaggggttccaggtggattttaagagcactttacagctttgaaacacttgtacacttccacacttatagaattttccctgactctgccttatatcacctacaaactgaggactggactattgggactgtatttctccctgatgtttctcagctctaaaattctagggccttatttacattggagaacaaatgggaaatctaatagaattccttaaaagcttcccgccagtcttgagcatttatcattccatgtgtctttgctgtcttgtatatattcttcttgtttttattatggattctttgactttgctatgcaccaatatagaatatgtattaactcactggttggagtaaagacaggcattttatttttagttataagattttacacaaaaatattctgattttggcaatgcattttaatcaagattttagaaaattgccagtgtttttacacatatgttctgttttcctgggaggaagtaggcgtttgtgcttaatcataacaagaactatctttttttaaacatcttttaaaaaatatttcagatctacagaaaagtggcaagaatagtgcaatgaacaccagtctgcctttcgactagattcactaattgcgaacatctccacatttgctttctctttctctggacagatactttcctccacccctgagtcatttgagaatcaattacaaacatccagatgcttcccccctgagcacctcagcatctgtctcctaaggacaaagacattctcctatgtaaccacaatgccattatcatagcccacgtcaaatctctccaattgttgaatagcatcttaaatcatcttttctctcaaattaccactagtgagctaaaatcaaatggggtgtttattatgttttgcatctggtttttttgtttatttttttgaagccacttcactgtgtcactcaggttggagtgcagtggcgtgaacacagctcactgcagcctcaacctccatgggctcaggtgatcctcctacctcagcctcccgagtagctgggactacaggcatgtgccaccatgcccggatacatatatatatattttgtgtatttcttgtagaaaaatacaacatgggttttgccatgttgcccaggatggtctccaactcctgggctcaaatgatctgcccgcctcagtctcccaaactgctgggattacaggcgtgagccactgcacctggcctattttttgcatctgaagaaatgattttaataactatatgtcatcttagtaacgatataggatgaaagataacatgttctatataatacacccatatattacatatgacgtgtgtatgtatatataaaaattatctctaagaaaaacttttggagcagtattggttaatagtcttctaggctacaaatctcttctttcaagggacaacttctgattagaatcagcccaatgcggccgggcacggtggttcacgcctataatcccagcactttgggaggccgaggtgggcggatcacctgaggtcaggagttcgagaccagcctgaccaacatggagaaacctcatctctactaaaaatacaaaaattagccaggcgtggtggtgcatgtttgtaattccagctactcgggaaactgaggcaggagaattgcttgaacccgggaggtggaagttgcgttgagctgagatcctgccattacactccagcctgggcaataagagcgaaactttgtctcaaaaaaaaaaaaaaaaaaaaaaaaaaaaagaatgggcccaatgctgcctattgtcagaatttatacttgtagcgaatgctagcaaaacttgaacttgaaaaacagcctgtgcggcttcttaagtttttacttgctcacttctaccagtcacatctcttgtctcttatttttctctttacccatagacttaaaagcatgagggtaaacttgcacttggaagcatgaaaaatccactaatagatactcttgtgaaacattaactaaaaatatatggagacaagtgataattacagggtgtgttcacaagagtgcgttttgaaaccagagaaggggggaaacgacaggcacaagggtggtaatgggaaaatggagaggcaaaggttatttatcacctcactgttcaattgtttgatctttggacaggcttaatttttcctaggaaagccaagagtaacatattttaagagctctgggcaccacaggcttctgtgggttattctgcttgaaggtgacagcatgcaatgtcttgaaaagcaccttcaggaagagggtacagtgttagtacctggtccctgcaaaacaaaatgggtgtgaaatgctatccatgggttcttgttatctttgatcctgaagtttaaaagagaccttgaatactcaaatgctgctttcccagaaagtatagcttgcttgtcacctgacctggtgtctaccttccctggaccttcagacaaagttcacttccaacctttgcctgggctgtgaggctcactgtcttttgggtcagcctgtgctcaccttcagcagttgagttcccagaggtctcctgaccatagcctgtgcttcttgagtgcgtatctttactatgggcagtgtgctgacctaggcacccaactcccacggcctccttaaatccttgctgcaactttatgaagtggatgctgttggtccccccagtctgtagagacatccaaggacctgctcagggtcacactgctggtcagcagtagagctgggattcaagttcaggcccagcctgcaccctcaaccaccgtgccacatgcccctcccaggagaagggcttctctgaggacaaccattgtatgttaacattaggaccacaggtagtatcacacttaagtgttaggtttacatctggaggtataagaaggttctttttctgaggtgtaagaaagttcttttcctgatgaaaatgatataggcctttgtctgttttgcactgctataacagagtacctgagactggctaatttataaagaagagaaatttatttcctcacagttctggagggtggctgggaagtcccagatcaaggtgctggcatctggtgagggccttcttgctgtgtcatcatgtggtagaaggcatcacatgggtgagagagagggaaggggactgaactcatccttttaccaggaacccattcccatgataactaacccattccaatgataatggcattaatccattcatgggggcagagcccttataacttaattgcttcttaaagattccacctctcaacactgttgcactgaggattaagcttgcaacacatcaactttggggaatgcattcaaaccatagcagctttcttttactggtggggaaaaaaacaagtttaaaagactggaaaaatacatacgtacttatgggactgctcattgatttcctcattgtagattccattctcacactacttggtgacacagcagcgcaggttggaagccagaaatgggaaataaactgcttcaggttagaggcaggactctgtcaggcaggactgggcatagtgtgtactcggcctctgagtagggcaccacccctcccttcccgtctgctgaagagactcacctgcaacttgggacatccatgagtatctcagacacccctctgctactctgtggcccactgacccatcccttagtctcccctgttagtttttaatacacttaaaacactgtgagattccaggccgggtacagtggctcatgcctgtaatcctagcactttgggaggctgaggcgtgtggttcacagggtcaggagatcgagaccatcctggctaacacggtgaaaccccgtctctactaaaaatacaaaaaaaaaaaaaaaagttagccgggcatggtggcgggcgcctgtagtcccagctactcaggaggctgaggcaggagaatggcgtgaacccgggaggcggagcttgcagtgagccgagatcgtgccactgcactccagcctgggcgacagagcaagactccgtctcaaaaaaacaaaaaacaaaaaacactgagagattccattattgagtacttgatctgaacttgacactgtgtcgaactcctcagtggagatggaaaataaaaagatctaatccttgtgcttgatgagcctacacttaatttatgagaggagatgcatttatgaaataatagaggaagttaaagctgtttgtagtaaataacggtattagattcctatggctgttgtaacaaattaccacaaacacagtggcttaaaacacatatacatttcttctggaagtcagagatataaagtgggttggcagggcagtgttccttctggagggtgtacgagagaatccatttccttgctttttccagcttctagaggccacttgcccacggccatcctccatcttcaaagccagcagcatagcatcttccagtctctctgatctctgctttgtggtcatatccccttttctgaccctgaccctcctgccttcctgttttaagagcctttgtggttacaatgggcccaccctgataatccagaatcttcccttctcaagagcctcaatttacaggctgggcatggtggctaattcctgtaatcccagaactttgggaggccaaggctggaggatcatttgaagccaggagttccagaccagcctgggcaacatggcgaaaccccatctctacaaaaaaataccaaaaaattagccgggcatggtggcatgcacctgtggccccagctacttggaaggctgaggtgggaggatcacttgaagccaggagtcagaggctgtaatgagctatgatcatgccactgcaccccagccttggagacagagtgagatcctgtctcaaaaaaaaaaaaagatcctcaacttaatcacatctgcaaagtcccttttgccacagattcataggtttcagggactaggatgcggatatctttagggtaggggaggcattattcagtctcctactatgagttactgaaaatgaattgatgatgtataggttatttatttggtaggctgagcataacaatggcattaattatgaggcagtaaggggaactggagggggcccctaaagcatgaggaatgggagggagaaggtatcttgggaaaagtagagaaggaggtggtctgtgtgtagtatggtggtgggtaggagagtggaggtgccattgacaatggccccagctagctgtggtagaagctacaggttcgaatacatgaggagggcatggctagtctgggctcctgtgtgaggtaggacctgagagccacccagaagagtttaggtttagtctgtagtgatggaggctgctggagctagcagtgcaacccaacattagggaaagtaatgctgatgtaaaactgcttgatactttatgtacaatttgaatatgacttagaatcaaaatcagaatcaggcttgaaaacctaatgagcagtaggaaaggaatgaattggagaatacttgtaaagaatactagaggaggccgggcgtggtggctcatgcctataatcccagcactttgggaggctgaggtgggcggattgcttcagcccaggaattcaagaccagcctgggcaacatgatgaaaccccgatgctacaaagtggaaaaaaaaaatgctagaggaaattgctgtatgttgcctaagagtctggaaatagaaatagctgctggtgagtaggctttccctttgtctccaggtgaaatattcaacgatgaggaacaaaaggaaagctgggcttaccagggtaggtcaggtaggtccagtcaggaatttcactgttgctaagagaacctaactcctgtagactttgttgtttaaggcacctgggatgctgtaaagtcttgaactcattacacttttattatgggctgcagaaaacatcagtaaaggttaattagtgccatatttatccttacatgctgattttacatctcctaaagctttatcacttattgatccttttttatttttctcatactatatggctcagttccaagagaggacaaatctggggatcagatgacagccagtatttaggctgaattagaggaagcaaaggcaatccttttgcaatggaagatgcgttttcctttcagatgcaaaaatctagagtattttggaaatgttggtgttaaatctaaagcatatttgagattattttctttaaccaccccagtaacaataaaatagatatgttttgaaactgtgatgttctcctgtctctcaggcttttagtggaaggaatgcaaggaacaaagacatttttgttaatttttgctgctgaatcaggttgcttataacccaagaggcagccagccatcatcatcttgtaggatccagcttgtaggatcatctgataactctgcaaggcagctggtgtgtcaggcttgggcaccatagtctctgccttgccctgaccttccgcttcctgagtgttggggttccaccagctggtgcctggcagcgttctttgcctgagtatgtgatggtgattcccagatgagatctcctaagctaggcccacacagaaccttcctgttccctccctccatcagcgacttgcctgtcaattctctccctgcttttctcctttcactgatgttcagggcaacatttggtactggagacctattttcacctgcttcccacctcttctctagcattttttgccttctccactggttcctacgctagcatgttttaatcagaggatcacagtggcatttataccttggattttctttctgtgctatcatttcaggagaaggtagcgtttattacttctgaaaacagcagggataatgtgaactaataccctagtgtaaggcctaaatactacattttactcttgatgacttaaacttgtattttcattagtaaaatacgatgtgcaaagtttaaaaagccaacagttctgaaaagcctataatgacaaagtcattaatcctcactccctctgtaccactctttagcttcttctagctctttctctgtgtttgtctccatgttgctaaataatctcatagtattctttgaggactttttagacttctcccgctttgttgaaggagtttttaatgctcttaggcagcccctatgcccactgcattttccttctctccccacctcccacccctacacttgacttttggaaatattttctggtcttcaagtgtttgtcaagttcatcccaagtaagcagtaaggcagatttcctgttctttttcttttcttttgtttacatttttgagacaaggtcttgctctgtcatccaggctggagtgcagtggtgtgatcatagctcactgcaacctccgcctcctaggctctagcaatctttccacctcagcctcctgaatagctgggactgcagcctgtgccaccacacccagctaatttttgtattttttgtagagaccatattgtccaggctggtctcgaacttctggctccagtgatctgtctgccttggtctcccaaagggttgggattgcaggcgtgagccactgcacctggcctcctgttcttagttggctaattttactctaatctcaatgcttcataccagaatatttcttgaataccaaccttgccagtaactgaacaaactacatgtaaagactcttcttgggtattgggtattgggacccaacacagtgaggaagactgaagagtcgtagtgcacttctatcaagaaattaggggaggttatccctgtagtctgcctagatggttcaggttgtctgaaacttaaatggaagttgaggctctgaatacacgtaggacttctgaatctgtggcaggtggtgcagtcttacctgatttagagaatacatagagaggccaggcatctatgtgcaactcagcttcatcggccagaagtgaatgccctatctcacctcactccagtaatacttaacctagccataattagctaaccaaagataggaacaagatgccaaggccaagagcacttgagaattgagcagtccatctaacaagggaggtcatcgagtttcttctccaccctttccctgaagtaactcttggagcaagcttgggacactgtgttcagatggctcggaaagttctggggcactgataagatcagacattttgttgggaattttttacctcagaaaattccagttgtcaaagattcctgtagagcaatatgtggcaattacggtatgggaaaaaaacaacaacaacaaatgaaaggttttatgagagggaagctcaagcaattccattagaacaggtcgactcacccaactgtagtctgttctaacaactttaaaaaagaagatgagatgaaaccatgagatcgtagtgaacagaactgagaaaacagatgaattacgagactcaccaggataggcttttcataaaaatcacctgtttctcaatttctgcagtgcgattgtgatcataaatataaagccactccggctctcaaagattgactgtctctcccacaaagcactcgccagacacaaactgagagaaaggcagggatggggaagaacctcgttctgtgagggcacagagagaggaccctgactcagctatggctcccagaaataccagctcctggagtggctgatgttggatagtggagctaagatttcagggttaagcatggtttcatttaggaaaagagggcagaggaatgggaggagattgtccaggcagagggcacagtgtgggccaagtcgccacggcgggaggaaaggagatgcagttgaaaaactcaaagaaccagcactcagggtgagaggggcagggaatataagataaggctggacggttaggctggcctgataccatgaggtcaagggtttcaagcaggaaaaatgccgcactaagatttgctgtgtgaatagaccactctgcctgcagtaggtagggtgtgctggggccatgggaatgttgagtggccagtcagtgagccattgctgtagcctgggagaaggctggagagaagtggatggatgcgggaattctggaggggataaatccacaggacttgacagagtggctatgagggagagggagcgatcaagggtgccacttaagtttccgacctacagagtgtgctagactggatgatacttctttctttcttttcttttcttttccttttcttttcttctttctttctttctttctttctttctttctttctttctttctttctttcttttcttttccttttcttttcctttctctttctttctttctttctttctctttttttggaatccctctaatggttttctataaataggttcttttggtatacctttccacagtacaagtactgatagatttgcttatggaaaatctttagggaatgcactgggcagtgggggaagagggttatcatgaaagatgtgaacaccgaagtgggaggcctcagcaatccagatctcgaagtgtgaggactacttggaactgatggtttgagtaatggcaggagggacatcatcaagatgctcctgatacattgttttataagtgatttaaatgaaagatgagaagcagatggaaaggaagtacaatgtgcagtgtgtctatgtcatgcctgtatttgaacatgatcgttggaaagactgatcaaatgttatagtttagggaccatgcttacccaatgatcattcctttaaacgtaaagcttgaaatttgggaaatgacatttttacaagatggcaaaactggacttgttttgttttctaaggtgattgatatgcccgagcacaaccctggcaatttgggaggaacaatgagactgggaataagaagaactgttttcaaaactgaaaattcaatattaagtaagtttcccatattgtttattttacaagatgttggatgtggctcatgtgactgcaggtgcccagcactctgggtggtggagactccccctgccccttccagcatcctcggagggccctgattctctctcttcccatctcccctgccctcactgaccctctgctctgggcattcttctccctagtaagcttgtcccttgggctggcctcagtagaacacactgaatgcccctccgcatttgatctgcgtgactccctgttcattgggctgttttgtgagttaccgatgctcctggagatgaacttggactgggacttggactgattcacactcagttcttttgaatccacagttctctccattacatttgaaccggttccctgtttaatgtctgtttgcctggtcttagtgactcacaaatgaacttccgagtaggagggcagttatgcacctcagaagcgtatttctctgttccctggcagccccagtgtggggagatggctcgccatttgatatttgctgatctttccactccccataaggttaattctaatttctgtggaactttttcataaattagcatattatataagaataacttattgtttaaaacaaactaaagcctttaattcaatttaataaatgtatcttgagtgcccactctgtgccatgtgcagatataatagtgaccaggacagataccagccctgccctcctagggcctcaaaacaaggggaagaaatgtgacaaaaggggaaggcagattgctaaggggaccggatgcagagagggagctcaggaattgtgagtgttcagtgtcattttcgtgaaattataagaatcccttagaatcctgtgaagttataagaattcttttttttttttttttttgagacagagtctcgctctgtcacccaggctggagtgcagtggcacgatttcggctcactgcaagctccgcctcctgggttgacgtcattctcctgcctcagcctcccgagtagctgggactacaggcgcctaccaccgcgcccggctaattttttgtatttttagtagagatggggtttcacagtgttagccaggatggtcttgatctcctgacctcatgatctgcccgcctcggcctcccaaagtgctgggattacaggcgtgagtcaccacgcccggcaagaattcttcagaaaaatgccttcttaactcaagaaagagtaagaccagaaatatgagcttttcctttaaagatgaatataaaccttctaaggaatagaaagcttcctagccagaatgaaattaaaaaaggaaaggcttcaaagtgaatacagtttcctcctttctctgcataaaaagccattgttctctaagtcactaacatttttccttacacatactatataagaactttttttcttcatgaatgttagcaattctgtagctttcaggtgtcttcagattctatgaaactttgttcaagtaattgcctacgtgacaaaaaatggttggtgaaaaattaatgtcctaaaattatatctattgagaaagattcagtgataattgtactaagtttttaaaaagagcattgtactcaatatagttaaaaatttgatagatataagtctgatttaagatttttcttggccagtcgcactggctcacaccagcactttgggaggctgtggccggcagattgcttgagcccaggaattcaagaccagccttggcaacatggggagaccctgcctctacaaaaaatacaaaaattagcctggcatggtggctcatgcctgtggtcccagccacttgggaggctgaagcgggacgatcacctgagcccaagaggttgaggctgcagtgagccatgatggtgccactgcactccagcctgggtaaaaaagatttgtttttcttagtgctggatgtggtgtaatgtgcctgtagtcccagctgcttgggaggctgaggtgggaggattgcttgagcccaggagtcggagaccagctgggcaacatagtgagactccgtctcaatttaaaaagtaaaatttgtttttcttcacagtagacataaaaatattgatgatttgatgattttcatgaatcttaaacacagcagcaaagcttgttttgaaaaattttgaaaacaactttattgagatataatacatcatataatttgtctattagtagtgtacaattcactgattttattttttattttttatttttttttgagacggagtctggctctgtcgcccaggctggagtgcagtggcgaaatctcggctcactgcaagctccgcctcccaggttcacgccattctcctgcctcagcctcccaagtagctgggactacaggcgcctgccggctatttttttttgtatttttagtagagatggggtttcaccgtgttagccgggatagtcttgatctcctgacctcgtgatctgcccgcctcggcctcccaaagtgctgggattacaggcgtgagccaccgcgcccggcccaattcactgatttttttagtgcattcacagaattgtgcaaccatcaccgcaattttaggatattttcatcacctcctgtagaaaccctgtgcccattagctgtcaccatccctacttcccgccagcccctggcaaccactaatctactttctgtctataggtttgcccattatggacatttcatgtaaatggaaccatatgatttgtggtcttttgtgtctggcttctttctttcttttttctttttttgagatagtctcactctgttgcccaggctggagtgcagtggcatgatctcggctcaccgcaaccttcacctcctgggtttaagcgattctcctgcctcagcctcctgagtagctgggattacaggcacccactaccacgcctggctgatttttgtatttttagtagagacggggtttcgttggccacactggtctcgaactcctgacctcaggtgatctgcccaccttggcctcctgaagtgctgggattacaggcgtgagccaccatgcctggtctgtctcctttcttctagcataatgtttttttgctacatccacattgtagcatgtatcagtacttcattccttttaatggccaaataatattccattgtatggatagaccacattttgtttatccattcctcagctggtggacatttgggttgtttccaggcaacaatttctttaattttttctccttaattttttaaaaagtcctttttctaaagggaaagaaaagtatgttgccttaaatttaagttgtgcttcatagtttccaagaagtatgtgatatatgaacttgtgccctcccacttgtgcagcactgtcttccacaggtctccaaaaaaggctgtgccagagataagaatgtgaccactgtgcaaggctctactgagtggcatacaaatatcaaaacatatagcatgatagtgtttttttgttttcttttgttttttgagacggagtttcactcttgttgcccaggttggagtgcagtggtgtgatctcggctcactgcaacctccgtctcccaggttcaagtgattctcctgcctcagcctcccaagtagctgagattacaggcatgtgccaccacgccctcctaattttgtgtatttttagtagagacggggtttctccatgttggtcaggctggtctcgaacccccaacctcaagtgatctacccgcctcagcctcccaaagtgctgagattgcaggcatgagccgccgtgcctggccgatagtgttttatgaacgtttttttttctcctagtcaacatatttcttttgtagaattttatgtatttatttatgtttttataagctggtacatttcttttgtaggattcccccatcccgtattggcatatttcttttgtagacttttttccaagtcagcacatttttgcaagaatgctatgaacaaaatacatttgcctacattgcctgtgaaaacaattaacaattttgatagaaagcattgaaatgctactcatttttttcatttaaatttgacttataggccagtagttacaatgcttggattaaatagaaaaacaggaaagtaaagagtcctctagtaaaaaataatgccttgaaatagggtcacagcctaaagatattgatagccgcagtggatggatgactagagtgagcctttttttttttttttctctttttgagacagagttttgctcttgtcacccaggctggagtgcagtgacaccatctcggctcactgcaacctccgcctcccaggttcaaccgattctcctgcctcagcctctcgagtagccgagagtacaggcatgcgctactatgcctggctaattttttgtattttatttgatgtggggtttcaccaccttggccaggctagtctggaattcctgacttagggtgatcctcctgcctcggcctcccaaggtgctgggattatgggcgtgagctactgcacccagccgagcctaacttttatattcaagaacaattcctctttttttcttaataacctgttaattccttaagggttatgaaaactatgaattcactttttctgaagtggagattataggtttgaattgatttggacaaaagtactggtaatgattatttgccctacttataagcagtgtgttcctagaagttcccttcctgtgttctatgtgttgtcttcatctgcaaaggccttttcctataaaagggctaatgacagtgtgtgtagaattatcaaagctgattcaagggtccttagaaatgagacattttgaggaagagggagagatttgttaaaggattcaaaataattaccctgatttgatcactatacattatatgtattgaaatatcactatgtgccccataaatatgtataattattgtcaattaaaaaaagaaagaagattttttctaaactgtattatctataatcctgtatctgagtattaactgcatatccatggtcttttccagacttcatcaagattagtttttatgtagtcttttctggtggcatcactttttcctgtatctggtcttcctgtctatgatctgtgcatatagtatttaatcgcgttaaggaggcatattctgctgattcatttcctactgataaaacacttcacatggtttctggcattttgttagaaaaatgctgaatcgaacatcctgacacagtgttttcgttcttttgaatatttccttagtatagatttccaggagttggattattaggtcaaagggtatgaacacttttatgactgataattctgccagactgttggaaagaagggctgagcaaggtcataatgacattcactgtacttgtgtccctgctttccctagtctttttggtaggattatttttcttcttgctgtattaatggaaacaaaaagagccctatttctgttcattgctaaaaagtgaaaacgttttctacttcgaatgttgatttacttgtgtatatagtgcccaggtctgaagtctttattaggacttaactatgggttggtaaactttttcaataaagggccagttagtaaatatttttggctttgtagccattgtggtgtgtaaacagctacaggcaaatatgtgagtgaacgagcacggctgtgtcccagcaaaactttatctatgggcgctgaaagttgattccatatcattttcatgtggcatgaaataatattctttgatttaattttttcaaccaatttaaaatgtaaaaaccattcttagttcaagggccaaacagaaacagtcagggggatcccatgactgtgggctgggccatagtctgttgaattctggtccaaacaagaacctttcagcctgggcaacatagtgagaccctgtctctacaaaaaaatttttaaaaaatcagccaggtgtggtggcatacacctgtagtcccagctactcaggaggctgaggcaggaggattgcttgagcccagggagttgaggctgcagtgagccatgattgtaccaccgcactccagtctgggcaatagagtgagaccctgtctcaaaaaaaaaaaaaaaaacaaaagaaaagaaaaagaaaaagaactgcatgttgaatgaactccacggatgaggcagtgagctgctcccatcctaggcagagttgaaggacatcatctccccacttctctactggcttgcatacatatcctattttatgacagagaataggactaagggggctttcagaagccgtttgatctaacctccttatttttcagctgaggaaatggagggctgagagatgaagtggcacacagttgggagagtcagaaccagggcttggacactcttcccacgttattttctagtcttctaataaaacatgctgtcctggctcccccatctagtgctataatcactctccaaaatgtaactcttggccaggcatggtggctcatgcctgtaatcccagcactttgggaggccaaggcggccagatcacttgaggtcaagggtttgagaccagcctggctatcatggtgaaaccttgtctctactaaaaatacaaaaattagccgggcatggtgtggtgtgtgcctgtagtcccagctacttaagaggctgaggcaggagaatagcttgaacccgggaggcggaggttgcagtgagccgagatcatgccactgcactccagcctaggtgacagagcaagactctgtctcaaaaaaaaaaagaaagaaagaaaaaaaaggtaactcttgaaacacccaattgttagactccttgatgctctaccttcaggtctgtatatttagttgcatgtaaattatacctcgattttttaaaaactcatttttctccttttaaaaaagtttttaattttaaaaaatagagacggggtttctctttgttgcccaggctggtctttaactcctggcctccagcaatcctcctgcctcagcctcccaaagtgctgggattacaggcatgagtcactgtgtctggccttaaaaaagcttatactatctggaaagttagatagtagggcttgtctccttatagtgatgctattagttgattaattaactcattagacgatttttgaaaagcagggagaagtggcacagtgtgggtaagtcttaagtggggtgctttgaaaagtaagaaatgtagaatgaggagtggctaaagatggagggatcaggctcaggtgagaggggagccaggggaacactgaggaactaagttaatagacggttttaagactccaaaaataaactttattgttttgcttgtggctctcaactgagagcacaagagatgggaacataataaagcacaaagaaattcagacaaggttcagagctcattcagggatggccaacaacttgatagtgtctctaaaatattacaagaccctggccttaatttgcttggtcaagtcccagatgtgttgccaagacatccagcgagggaggcaagactttgtgttgaatgtggtttccaaaccaaactgccacctgctagaaagaacatgtttttcagaccatttcagttcacatgtttgaatactgcacaatctggtgtgtgtgaatttagtaggaatgctagccccaaacttatttatttatttctttattttagagacagggtttcactgtgttgtccaggctgaagggcagtggtgtgatcgtagctcgctgcagcctcaacctcctgggcccaagcagtcctcctgcctcagcctcctgagtagttgggactacagccacatgccaccacgcctggctaatttctaatttttttttttttttgagacagagtcttgctctgtcgcccaggctggagtgcagtggcatgatcttggctcactgcaacctccacctcccgggttcaagcaattctcctatctcagccacccgagtagctggagctacaggcgcccgccaccacgcctggctaatttttgtatttttagtagagacgggtttcaccatattggtcaggctggtctcaaacttctgacctcaggtgatccacccgcctcggcctcctgaagtactgagattacaggcatgagccactgtgcctggcctaaaatttttgtagagatgaggtctctttgttgcccaagctgatctgaaactcttggcctcaagagatcctcaatggccttttgtacactttttcaataagggaccagatagtaaatatctttggctttgcagccattgtggtgtgaaagcagctacagacaaatatgtgagtgaatgagcatggttgtgtcccaacagagttttatttatgggtgctgaaagttgatttcatatcattttcacgtggcatgaaatgttattcttcattttgtccagccatcaacctaatttaaagctcccaaattctctatgccctccaaaccagcacccaaacagttagggagcacttacccttagaagcaggggaatgccacaaggtggaagggtgcagagaagacccacaggctcgaggagagagaggagggaagaggtgggccttgagcacggggttgtactgtgggctccctatagggaggtgtatctggtccggttaagaatgcaacacaacacagggccgggcgcggtggctcacacctgtaatcccagcactttgggaggccgaggtgggcggatcacctgaggttgggagtttgagaccagcctgacttacctggagaaaccccatctctactaaaaatacaaaattagccaggcgtggtggcacatgcctgtaatcccagcaactcgggtggctgaggcaagagaattgctggaacccgggaggcagaggttgcagtgagccgagatcacaccactgcactccaacctgggcaacagagcaagactctgtgtcaaaaaaaaaaaaaaaaaaaaatacaacacaacaaacttgaaggaattaggagcccagggcagtgcagtttatacaactggagactaggacctggtgatttccggagttctgtgaagctggccctcatcctcagagcagatgacatgaggacagtgaggtttgatgcaggcagataacagctggcagaggaggccagggagagctcctcaggttgatgccggcaggagcatgacatgactctggcatacaagacacgagtgaagccttctggacctggcaggtggaaatggaatgctttaagaaaaggcttcattcctttcagggaccttctctgcatttcctcgtattaaagaagaagaacttgactaaaacgaccagttctgctttaatgtaagggaaaaagtgttttgtttggaaagaacagaggcacgaggcccattaaaaagatattgagtgagacccagtgctgggagtcccggtacagtttatggcattgcaaatgcagagtggttaagtctaaaatttgaaagagctgaaagaaatggggagaagttttcaggggctagaaaaatggcttttgctttcttgtctcttatcaaagcattgatatggaaaaacagcttctggctcctggtgtgattagattaggaagtttaaaaattaaaaccaaaaccaacattgaatgttcgtgaaacattagagcaggggaaaaaaaagaaaaaccatgtaaaaaaaaaaaatcctcgactgagttaatgaggtaatttacataacagtttaaaagaggtcgcccgggatttagggaccctgagtccatgccatggtaatttgtcattgtgctgagacacaaattccagaggagcacggcagggcttcgtgagagctgcataccacttggcgagcctccccgcctgcccccagagcccaggtccacactgcagggtggctgtcttcttactgcttcttgccttttactggggaaaccattcgctaaagcgtgtttgttaatatggaggttcataggtctgggacatagcacctttcatcctaacaacagatggcattcctgccccctctctagacaagcacttgtcctcatcacttcaccgaagggaactagtggagtggttaagagcccagcctgtggagccactgctcaccagaggcccgttgggcctcagctctcagtctctggctatgtggagctacttacccgcaccacgcctcagtttctgcatctgaaagacagagataagagcgccgcctcatggggttcttgtgagggttaaataaatgatatgcgggagcccttagaacagtgcctggcacagaaaaggcactgtttaagtgtggctgatatttgagagcattgacctgtgatcttctcaaagcttggggcaaacgtcggttagtgacctggcattaagaatgaggtcccactaggggagtgggagggaagaataggctttcccttgctcttgcaaggttatttctattctgtctttcttggctgctagctccccacttgccaatgcataagatctaagaaaagagatgccaagaatgaggtaagaatactaaatggaaaacaaatgaaagtgatgaaaggtggggtgtggtggcttacgtctgtaatcccagcactttgggaggccgaggtgggtgaatcacttgaggtcaggactttgagaccagcctggccaacatggagaaaccccgtctctactaaaactacaaaaattagccaggcgtgatggtgcatgcctgtaatcccagctacttgagagactgagtcaggagaatcacttgaacccaggaagtggaggttgcagtgagccgagatcacaccactgcactccagcctgggcgacagagtgagactccgttttaaaaaacaaaacaaaaagaacaaaaaaagtgatgaaaaagaatgtaatgctataatatagagttaaaagcaaagacgcatttttcaactcagatgtattatactaaaaaattgagataaaagcagattaggaagataaaattagggaagggggaggagtttagatactaaaagaaatgaaatattttataaaaattggagaaatgacattctaaaattcaaaagtaagaaataaaggagaaatataggagaaagtaaaggagaaataaaggagccagctgtggctggctgcaactcggtgctttctgcacaccagtaattaagacattgctctcatcacccctaggacccagccaccattttgcacaaaagaaaggaatcttagcaaagttaagtcactcatccaggtcacttgttagaaagtcattgagctgactctttgaccacctcactgtaccaaacggctggaccttaatcaaagaagaggcagaaaaacccaaacagctcccagagctggatgctgccctcactgagaatcctgagaaaaggttttgcaggtttcgggggtgtctggtgggtggagagcagggggtgcagaaagcgaagaccctaccccaggcctcttctgaaagccagtctgaaaccgcgggtttagcttaaggatagacacaagcactgagtcagttttgcactgagcatctaggccagtagggcatgcagacaggcaggtgtgagaaatgccacagcttaagctcaacaatcagcagcagctacactgagccttagagttagagaggcagtaaggagtggtagggactgtggcaaatcagcaagcatgtgccccatcaaagaagtgacttccacagctggtagttgtatcaagaactgtggattcactgctgccagtcttctaaattttcaagaaaatctggaaatctggagttttatgtaaaatctcctgacgtttaaatgttggcaacttatttacatttttaaaatattgtgtgtttgccagcactctgcaagcgaaatacaacaaatatctgcaccctgggcagcctcttaggatctttgaattagataagcactgaattagataagcatcagcaaattcttgcacatacgagagggctctggtccttaaaatgcctaattagcagaaggcatggttgcaggtagtcttaaaagtgaagtaaattaagacactggtgcaaaaaggacatttgtgtaaaagcaaggcaattctaccaagaaaagaggtaatgaagcccagcaggtagtggttttacttttttattaagttggtgcaaaagtaattgcggtttttgccgtcgaaaataatggcaaaaactgcagttacttttgtaccaatgtattagatgctatgggtgattgcctttagccccctggaaataggagatatggcaccgggggaaagataaggatcagaaggtatagaatgggagtggacagctatgtgggtgatagcttccaggggagcgaatgtgggagaagaaaagagggtacagtcttgggcaggggtccccagttgaggatgatgaacaggtagatggggcaaaaagtgcctggaggagcagaggtcacagaaggggaagggtggcagctgaagacagacctgctggattttagagagcagttctgtaaagtcacaggaacaaaagccaggttgcaaagggtgggagtgggaggtttgaataaagggtgagtcagagcaagagggcatcatggacaagagtggggctggatgatttttgttttttattttaaaaatttttaattgtggtaaaatatacataacataaaatgtaccatcttaaccatttcctagtgtacagttcaattgtgttaagtacattgcattgttgtacagtctccagaactcttctcatcttgcaaaactagaaactatacccattaaatagcaactcccccttcccctggcccctggcaaccaccattctattttctttctttcttttttttgagacagagtctcactttgttgcccagattggagtgcagtggcatgatcttggctcagtgcaacctctgcctccaggttcaagcgattctcctgcctcagcctcctgagtagctgggattacaggtgtccaccaccacgcccagctaatttttgtatatttagtagagatggagtttcaccatgttggccagcctggtctcgatctcctgacctcaagtgatctgccccccttggtctcccaaagtgctgggattacaggcatgagccaccatgcctggcctctattttctgcctctttgggtttgactactctagatgatatggacaggagaccgggaaatactgggcagaagagggcgattctctggcaaaggcccgaccctcaagcctggaaacctgtggccctaaataagaacaagcattcctgttttcacccccaaatgttgccttttggcccgccatgccccctatcctgtactatataaaccccaaaccccaggctccatgagcagaagagtggtgtggcagagaaggagagaagagaaggagcatctgaacatggagaggagtccggctggggaccattggagaggagattggctgctggacggccaaactccaggggaagatcatcttcccactccatctccttcctccccatccatcccactgagagccacctccaccactcaataaaatccccgcattcaccatccttcaagcccatgtgtgacctgattctttctgaattccggacaagaacccaggcaccaagaaggcactgagctggttaacacttaagccatctatggacggcagagctaaaagagcactgtagcaagcccagtggagtttccggagtcacaggcacccactcctagacactactgtgtggctggagcccaaaagtgttcgccctggatcctgcacctgcccgtctgtgtgctccccctcccataagggatttgagtgcacacagtggctgaacagatgagccatacctctgttgcacgtcctgtgaggggggtcagggaactctctcgttttatcgatacctccttgaagtagaatcatacagtatttgtccttttatgagtggcttatttcacttaacatattgtcctcaaggttcatccatattgtagcatgggacaggatttccttcctttcgaatgcagaataatattccattgtgtggatggatatgcacattttgtttatccattcatccctcagtgaacatttgggttgcttccaccttttaacttgtgtagcttttttggggggatattttggctctcaaaaggacaaaggaaaaaattaggttcagttgctaggattactcacatgagggtaggcatgggcaggaccattaaacaggtaaaaatatattatgtatgaggcagtatcttacccagtagcaaattagagaaagagatggtataatttggaaaggtggtttttgtttctgataacccttttatccacatttttggtgtctttctgcctgcattgggagtgctttataggtcctaagacttttgttggttttctttctctaaagctttgctgacatttacttcttaagtgaacattttattttgtctctaaaaagactaggacagaaagaaagactgagtcactttgttgttgagattttcccccattcctaggatcatttcatggcacctgtgacagaggactgctcttaggaacgtggtgtgtatacctctcagtttctgactctactcctagattttacattcaacagtatctagcattttgccttgtcgtggaatgttcttatactgcactttcaatgttggtgtagattagttgattctaaccagaaatgcatgtcagggtgacttgtggtgcatttttaaaacccacgtggccagacactctcctgagagtaatcaaatcagaatcgatggtactggggtacccgggctccagaatgagtattcttagttttattttgttttcgggatgttctcaaatagaatttcattggtagcattctgaactgattctcaacatagagtttttaaggaaattttaatttttcctttttcacaggtatagcaatggattaattttgtaaattcatttctgatagatttgtaagcaatgaagaaagattttgaatgcataaaatagaatttccaaagttctgaaaacatgtttcattgtatatcgtatctgttgtatgttgatttcattcaacaattcattattgagtacctgcttatctgctaggtgctggtcttaagaattgaggggatgggccaggcgcggtggctcacgcctgtaatcctaaggcgggtggatcacgaggtcaggagatagagaccatcctggctaacacggtgaaaccccgtctctactaaaaatacaaaaaattagccaggcatggtggcacacacctgtagtcccagctactcgggaggctgaggcaggagaattgcttgaacccgggaggcggaggttgcagtgagctgagattgcaccattgcactccagcctggcgacggagtgagactccgtctcagaaaaaaaaaaaaaaaaaaaaaaaaaaaaaaaagaattgaggggatgactgctgggtatatacccgaaaggaaggaagtcagtatatcaaagagatatcgcagtcccatgtttattgcagcaccagtcacagtagccaagatttagaagcgacctaagtgtccatcaacagatgaatggataaagaaaatgtacttatacacaatggagtactattcagccatagcaaagaatgagatcctgtcatttgcacagcacagatggaactggagatcattatgttaagtgaaacaagccaggcacagaaagacaaacatcgcatgttctcacttatttgtgggatctaaaaaccaaaacaattgaacccatggagatagcagaaggatggttgccaggggctgggaagggtagtggggggctggtagggaggtggggattgttaatgggttcaaaaagtagaaagaatgaataagacctactatttgatagcacaacagggtgactatagtcagtaataatttaattgtacatttaaaaataactctaagagagagtaattggattgtttgtaactgaaaggataaatgcttgaggagatggataccccattcaccatcatgtgattattacacattgtatgcctgtatcaaaacatctcatgtaccccctaaatatatatacctactgtatacccacaaaaatttaaaataaaagatttaaaaaaataattgaagggtcaggtccctattttgtctgttacctcgtatagcttatgttctagttccattcatttggattttattgtctggagataacaatatcaatcactgaaatggttcgctttctgttctcagtgcttcccatattttgatttatttaatccttacaactctatgaagtaggaactatcataatccctattttatagatgaggaaactgaggtagagaggttaaataatatgcccaagccacacatccgttaaatagtacagtggaatttaaagccaggaagtctgacttcagagtcactacactcccctacccctttctgtcacctctgagatatcttagcaaatacagagtctgccttaagccaggcagcagtcagaaaccatgcagtttcaaacattctcatgatatcctgctagtccccttgactcgaagatacgattccttatatcctaatttggagatttgtgccattttccccatcatctcgagaaatgttggcagactctagtattggatttacaaatcacctattgtaatgaagggaacagaaaagaaattttggactataggaggaaaagatcaatgtcaaagtcagaggtcataggacacttaggatcctctgaggcaacttcctgatgcttctatgttttctttctttttctttttctttctttttttttttttgagacagcatctcgctctgtcaccaaggttggcaggttggagtgcagtggtgacatcctggcttactgcaacctccgccttccaggttcaagtgattctcgtgccccagcctcctgagtagctgggattacaggtgcgcaccaccacgctgggctaatttttgtttagtagagatggggtttcaccatgttggccaggctggtcttgaactcctgaccttaagtgatcctccccctctcagcttcccaaagtgctgggattacaggtgtgagccaccgcgcccggccttcctgatgcgtctgtgttttctaactgtatgttattgtgctttatttcccatttttattttaatttttatgaagcagttgttttagtttaggctgtcctgaatgacccctgccagtggtatgttcgcattctctcaaaggaactccctgcccccactattccccttttttctaaaatacataccttaaatattcactatcattcatatcgtcaccagggagctcagtctatatggacagaattgcaaatagaagttcagctgtgatcattgatcgtacaaagttatatgagaatacaacccatttgtgtttgcttgatccaagtcaaaagctcaaacaagatgcaaagaaagcatttatttggtttttcttggttgaaacatcctgttccagcctcatgatgtctttgagagtctgataattccctgcctgttgaactgagcatggcttctgattctgttggagtttcagcatgacttccagcactgttatcttcttaacccttggctgtgtacctgggatctgcgttttgagggctagtgctgtaggaagagtctctggtcctctcagactgctccagtgctggagcccacttggtccctggaccatcctgcttctccacatgctccagtaggggcattctttttattattattattattattattattattatactttaagttctagggtacatgtgcacaatgtgcaggtttgttacataggtatacatgtgccatgttggtgtgctgcacccatcaactcatcatttacattaggtattctcctaatgctatccctcccccaaccccctaccccccgacaagccccggtgtgtgatgttcccaatgggagcattcttgagaggtgtttggtgatggatccgactcctattcacctgacaatgaagtcactaggcagctcgttgatcgccgtgcccatcgccacactggtcatgcccagggtgctgtgcttagctgcagtgcctcagctacgtaggcatgtttaggcagctccccagatgattctcagccacacacccctggttaagagctgttggcatagatgtgctatcatttaatccaccagtttgtctattcttgatgctcagcttgcttccaattatttgctattaaataattcagcagtgcacatctttgtggttaagtctttgtcctcatttctattttctgggataaattctgagaagtccaactgtaggatcataggataggtacatttttaaggtggagtacattttgaatgtggccagtacggtgtgaaaatctggaggcagctggtggagtggagaaagcattgggccaggtgtgaggaagcctgggatcaagaacaggctccgctgcccagcaaggcagggctttgggcaagtctcttccctgcccccagttttgttttcttcctttgtaaatgaggctcattacaaatctgcactgaagcgatagtgcagacatggccgtctcttagtcctgcaggcaggtgtatataaggagggcagatctgctggattctgtggtggacttgtgtagcatctggcttccttttatgcaatggtgatggcttacttgagaagtgcttcaggttttcaaagaagctatcgccatcttctattagaaaagaagaaaatctagatgactatatggagtctattagttcatttttagtcctctgatagatagatagtgatccaggcacttgcctccacaaagcatcatggatgtgcttgtgaagctgcttactctaatattaatctcgctcttgtatctttacagggaaactttatggtgatgttccttttatagaagaaagacacagacatcggttcgaggtacggctttcatgctgaattactggggaatatggatgcttagtgtgaggaacccagtgattacaagctgagcctctggaaaaggtgtctagcctggtggtattcacagggctcagagaggaccaaatttcccacagtctcccacttccagaggagatgggcggcgaggggacaggggtggggagtggggggcggaggctctcatgtttttggctttccaaaggcaaaatctttatgtacctgcacatggggcctatcaatgccctttgttactctaactgccatcttctagatcatgataaggccatcatttcttatccttagcccccaccctttattttgccaattttgtggaaaagaggacttgaatcttctgagaaggaaccaagtgccttttgggatgggggtgcatccctgggtatcagggggtgattagtttgagaacctctttggaaatttacattaagcttgaggcttagcgtcacatgactaaaaggagttaattgttgaggttgccacatgagaaacatagatttctcgaaatgtagatcgtctatgccaggattaatgagtgtgtcaattacgatgcatttgactgtgaagaacagaaatccctgcttgttgtcactcaaatcaccctaaacattaaggaaatttgttatctcaggcaccaggttgtccagaggctggacaggctccaggcatggcacaaccagggctcctgttgtctctgtggttatctcagccctacccttgtctgtgtgtctgcttcgtcctttagctggtctcccatatagttcccaggtggctgccagcagcatctgggacaagaggcatctctccagacagggaaatcaacttagattacctgcccacctgtgaactagtagccatttttcagggcaatgctgaacatcagtgggcttaaacctgggttcttgcaatattcatcttccaagagggctgggtttattatgtttggcttagaccagttagaaccagtttctggaatgggacagatggagtttcctggttcatataggggtggagtggataccaggacaagcctagggctctgttttgaaggaggactcgtgggaatcaatgccaagtaggcaatgaacagtgtcactatgaccaaggaacataatttggtacatgtaggacatttttggtcttatttccattgggaacgggcccaactggtgggataaaaattattgagctgctttggctaagtggcaatgagaaggtgcaagaactggtacgtacgcaatagcgtagccattcattcattcacacctattttgcatctggtatgcattggagatggaaaggggaaagacagacatggtctccctcttgttagggagcttacattctaatggagaggacaaaaaataagataacataataattacagattaaatcctgtattggataagggacttgtatctaaaatatatgaagagctcttacaactcaataatgaataattgcaaatgatatgaatagatatttcttcaaagaagatgtacaaatgactaataagcacatgaaaagatgcccaacaatcattagtgatcagggaaatgcgtattgaaaccacaaaaagataccacttcacacccactaagctggctataatcaagcacagacaataataacaagtagtggagaggatgtggggtaactggaaccttcatgcattgctggttggaatggaatatattgcagcccctttggaaaaccatctggaagtttttcaaaaagttagacataagaattaccatatgacccagcagttccactcctagatatatacccaagagaaatgaaaatgtatgtccacacaaaaacttttatctgaatgatcatagcagtaatattcataacagccaaaaaggcagaaacaactcaaatgtctaccaactggcgaatagataagcaaaatgtggtgtattcattcaatggagtattattcagtcatagaaggaaatgaagtactgatttatgctacaacatagataaaccttgaaaacatcatgctgagtgaaagaagccagatacagaagcccacatattgcatgattctattaatataaaatgaccagaataggcaaagctatagatgtgggatatagattagtgattgccaggggatcgggtcagggtgatggggggttgggggatgaggttaaagggtacagggtttgtttttcagttggttgtggtaatggttgtacacctctgaatatacgaaaaatcatttgtgtatttcaaatgggtgaattgtatggtatgtgaattatgtcttaaagctgttaaggaaggaaaaataatgacaatacgagaactggtataattttaaaatgtagaataaaagctctgaggttaagattgcaaagaataggtgagactccaccttaacttttgacagggaagcactttcactgaaggagaggctgaaaaggagtccttaggtttgggaaagggctaaggtgagatgggggccagaaagggccacaagccaggtcatcaagttgccatctattaggatattttagtagaaaacttgctccaagcttctctttagagcttttatgtaactgcatgtaaagaaagcattggggttagtcacaagggaaataggatagttttaatcttcaagcaaatttgtgattcggggagagatagggaagtacacataactcaagggaagaagcaaacatggaaatggctataaataactagtctcaaggttccaggtcagaatgtctgggttacagggcctactttttgaatctcacctttgggtaatagaaggcacctcctagatttaggtgctgtggttacattttatatctgaggttcatcattagtttaaaattggctttgagcattgaatatagacattaactactagttagaggatcactgaaatggaaaacccacccaactgatgaaggacctggtatggcagctggtattgcactgtggcccataaacacttaatttcttgttttgcaggtaaaccctaacctgatcaaacaatttgagcagaatgacttaagttttgtaggtcaggatgttgatggagacaggatggaaatcattgaactggcaagtaagtgggctcttcatttttgaaaaccttccaataacttgcctttttgtggaccacagactaatttgagacccagttttttttgcattctttcttttcttctctcctttgaaacaaatatgtaactacaaagtacatgaaaaaaacagactgctggctgggcatggtggctcacgcctgtaatcccagcactttgggaggctgaggttggcgaatcacctgaggtcaggagttcgagaccaggttggccaacatggtgaaaccccatctctactaaaaatacaaaaattagccaggtgtggtggcgtgcacctgtagtcccagctactcaggagactgaggcaggagagtcgcttgaacccaggatgtggaggttgcagtgagccgagatcgcgtcactgcactccagcctgggtgacagagtgagactttgtctcagaaaaacagactgcttataatcctgatcattttggagcctattagtctgactccaccataaaatgatgtattattccaagtctaccagttctacaagtagtatgcttccttaccaactcctctctttctgaggctacttctttgtgccagcctctaggttaggtgctctgggaaaggcagagtggcactgttgagtggcaccctgcctgctctcctcttttgagaaagaatagccaagtgccacctcatttttggtgactgatgttgatttctgttgcttgagggacctggctcctctcctgcctttctccactgtgctgggtggtcaagcacgggtcagtcatttaacttctgaacactaatcactgcccccagagttgtttttaagagcaaacagaacagaaataaaggcatcagaattgaggaagaacaccgaagttgttgttagtaaccaggctggaacacccgtgagcacataggcacaaactacacatttactattgatgagacagaaggcagtgttcttctcagtcagctttgcaaggacatggtaagctcatggtcacagctggtctcagctctttgtcttgatgttctagcccaggggttggcaaactactgcctgtgcaccacgtccagcctgctgtttacagccagcttatgagctgagaatgatttttacattttttaatggttaaaaaaatttaaaaaagaatactgtctgtgacatgtgaaaagtgtatgccattcaaatttgcatccataaataaagttttattggaacacagtttaggggtagaaaggtgttatctgtgaccttcttacccatcataagggtcatgaccaacaaccctataacaagacaggttgacaagagaaaagcataacaaatttatttaatcaaagttttatgtgacactttagtcttcaggaatgaagacccaaagacttggggaaaacttcatttgtatgcttaggtttgatgaacagtggacagccatgtagcaatgtgattgggcaaaagggcatactctaatggtaatagactgacagggaaacccagaaaggcctgtctgctcagattcttcttggcctttctgtgtagcatcccattcccccaggtctagagcaggactcatctggaatgagggtcttatgacctactttcaggaaaggtaggtcagataatttatttatagccagctttcacatggaaaggcgggggaaacatcacagtgaccttcttgctttggaggtcttcccagtcaccttcagttcaaactactttagggtagtattttctgagctccgacaacagcaacactcattcatttatgtcttgtctatggctgcttttaatttttattttttttgagacagggtctagctctgtcacccaggctggagtgcagtgccatgatcatggcttactgcagccttgacctcttgggcacaagtaatcctcccacctcagcctcccaaggagctgggactgcaggtgtgcatcaccctgcctggctactttttttttttcttgagatgaagtcttactctgttgcccaagctggagtgcagtggcgcgatcttggctcactgtaaccaccacctctcaggttcaagcaattctcctgcctcaccctcccgagtagctgggactacaggcatgttccaccatgcccggctaatttttgtattttttagtagagatggggtttcactatgttggccaggctggtcttgaactcctgacctcgtgatccgcctgccttggcctcccaaagtgctgggattacaggcatgagccacgacgcgcagccaattttaaaattttttttgtagcggcaggtttttgccatgttgctcaggctggtctcacctgggctcaaggcctcttccttcctcagcctcccaaagtgctgggattacaggcatgagccaccatgcgcagccaatttttaaattttttttgtagcggcagggttttgccatgttgctcaggctggtctcacctgggctcaaggcctcttccctccttagcctcccaaagtgctgagattacaggcatgagcaactgcacctggcccatggctgttttttatgctaccatggcagagatgagtagttaagaaagagaccttatggctcacaaagcctgaaatatttaccttttatagaatattggccctttacagaaacatttgctaactcctgggctagactcacacatatacacttcatttaactaacttgaatttaacattttcacgtgcctccttgacctgtttgtgtatttggatgttgtgttgccacttccatctcaacttatttaaaactaaatttacatggtctcccaattagttcattctcctgtttctgttaagatatcatcaatatccttgtccagggtttctcagccttgccactattgattgacatttggagtggaataattctttgtcgtggaggctgtcctgtgcactgtatagcaagcttgtccaacccacagtccgtgggctgcatgcagcccagggtggatttgaatgtggcccaacacaatttcgtaaactttcttaaaacattatgagatttttttgcaatttttttttaagctcatcagctatcattagtgttagtgtattttatgtatggtccaagacaattcatcttcttccagtgtggcccagggaagccaaaagattggacacccctgttgtagagtgtttggcagcattcctagcctctactcactgccactatcatccctacctcccacgttgtgacaacccaaaatatctccagacatcatcaaatgcccctggagagccaggtgcagtggctcacgcctgtaatcccaacgctttgggaggcgaaggtcggaagatcacttgaagccagaagttcgagaccagcgtgggcaacatagtgagatcctgtctctacaaaaaactaaataattagctgggcatggtggttcgtgcctgtggtcccagctacttaggaggctgaggtaggaggttgagcctgggaagttgaggctgcagtgagccatgatcatgccactgcacttcagcctgggtgacagaacaagaccctatcttaaaaaaaaaaaggcaagtccctggggggcacatttggtggagaaccattctcctagactatcaggctagaaatttcacatattagctcttcttccccttcagatcccaactagcagtgtgttgtcaagtcctgcagattctgcctctggaaagaaagctggtgtttagaattgcactgccatccctagaacactagtcccagtgcatgccaactccagctcacacttgtcctcaatctccttcctgcttccaagccatcccttctccaatacctcctaacaagaacagaactctgcagtgtgtgacactaatttgttggataaaccactctcatatattgagtactaagggtgtgcaggatactgtaaaaatggtaccgtgatgttccagaacctgcatttccagcctatatgctttaggctccagataaattggattgcctgtgcgtcttctaacctccctcttctttctccgtcttagctcatatcactattctccatttcaaatgccttttctctgtctcttttcctttttgtctctaatctgttcaagtacttccagagtcccgagcagaggggagaattgaagtccaagaaggctcctttgaacgttgtagcattttacctagacctgaaagaaggaaagcaatggacattcagtgtgcacttactggatgcttgtcactagacctcttgctagggactttgcataccttatgtaactaacaaagcagatgatgctattcccactttacagaggacaccggagtgcaaagaggttaaatgacatgcccagggccatccagctagtcctttgcagcaagagcaaacccagttggttacctccttctgccaccactgctgtgggatttcattgtttctcttgttttcacgttctacctaagatgatcaattcatgcctagagttttgaattagaatagtaagtacgcatttccaggagtctttctgatggaaatgcccatcatttagaattaaagtgtggatcgctgttggtattgaagcctcttaaatcttcctagcatgtgagaaggcagaaaatttcttaagcaaattactatttgtttactttgtttaagtacttattcacttttaattcttctggttgtcattattgtcatcaaatacttagaaggttctttcatcataaggatttagattcccactggggctttcaaatttcatgtggattgaaaaggaaatgagagctgctataaaaccttgcagtttttaaaagcggactgcaagcagttattaaggaaaattccccagaagattttgatcttagataccccttggaaacatatccacgaatctccactgttcctgaagggttctgagaggaacaacaaagcttgagattaatattatataatgtcagaatttggtttaaagcaatcaacagcattattttaaagataattttatctaactgatagaacatcatcaaaataaaaactttttactttctcctcatattggcatagaggattttttggataaagtgattcagagcaatgatccattcattcacatagtctgtccctggctattacatgattacattgctcagcatctgtctgtagtgatacaaaagcacagttactgtctgcttttttttcaaagatgtccctagatgttatgcagtaagatttattgtctcttaaattttaagctacattgcttaatttcttctctaagtgcggatgatttctctgcgtttcttgagggaatacattcctgggagaaggtggcattccccttatcaggctttcttacctgcatattcctctaattcaaggaggtttcttcttagatgtagaggatttctacactggatttttctgggatcagagctgtcctatagaactcactggatttttctgggatcagagctgtcctatagaactcactgcaatgatagaactagtccaccctatccaatatggtagccactagccacatgtaactttgaacatgtttcaaatgctgaattaatgttaatgaatttaagtagctacatatggctagtggctaccattttctatagcagagctttttttttttttttttaataatttcaactttcattttggatgcagggagtacatgcgcagttttttttgtttgtttgtttttgtttttgagatagggtctcaccctgtcacccaggctggagtgcagtggtattatcatggctcatggcaacctccacctcctgggctgaagcgatcctcccatctcagcctcccaagtagctggaaccacaggtgcacgccaccacgcccagctaatttttgtattttttgtacagacagggtttcaccatattgccccggctggtctcgagctcctaggctcaagaaatctgcccaccttggcctcccagagtgctgggattacaggcatgagttactgtgcttggcccacgtgcagatttgttacatggttatattgtgtgatgctaaggtttagggtatggatcccatcacccaagtactgactagagtacccaacagatagtttttcaactcttgcactcccctttccttcctccctctggtagttcccagtgtctattgttcccatctttatgtccataagtacccaatgtttagctcccatttataagtgagaacatgcagtatttggttttctgtttccgtgttaattcgtttagaataatggcccccagctgcatccatgttgctgcaaaggacatggtttcgtttttatggctgcatactattccatggtatatatgtgccacattttctttatccattccaccattgataggcatctagttgattccatggctttgctattgtgaatactgctgccatgaacatgtaagtgcatgtgtcttttttgtagaatgatttattttcctttgggtatatacccagtaatgggattactgagttgaatggtaattctggtttaagttctttgagaaatctccaaactgctttccacagtggctgaaataacttacattcccaccaacagtatgttttcttttctccacagccttgccagcatctgctgttttttgacttttttaataatagctgttctagcagggctttaaatgattaccttaagaaagtagacatttgcattcaatcatcatttccttattactgtagtagtagctttggatctttgctggtaagtgatgggaatttgtgattttgaattccatactagattttagatcatttgataaagcacctcattgaaagctttaaagttatatttacttccccctcttaaacttattatattttattatctttagtttgagtcatagccagggacaggatatttgaatgaatggatcattgctctgaatcactttgttcaaaaaatgctcagttttgtggtgctatgagtaatacccaacttaaagctgtgactagaaaagcaattgtcctcgttgggttcccaagggtagcccaatgggttgatattgtgctggtttatcccaggggacacttaccctgggaaaggagaagaccttgcaggaaatggcctgaagccacctaaagaaagaaagacccagggttagcctaaagtccaagggaaattgaaccaacataaatctacaaagtgccttcaaaaagcaggcagatttggggaaagtggaattcttcttgccattcaaaaatttttgcttgactttgctcactctgacaccttccgcacataaaatttccaagatgtgttttacaatttgaaattccacgaaggaatggatggatagtgaaagtaactggctgtaatgataacaggttaaagaatcatcttaccatttaatgagttttcatattcaaagataagaagatctttaaagcagttctcctgtttgtctgctttaatcgcatcgtgattgttctcatttcagatcatccttattttgttggtgtccagttccatcctgagttttcttctaggccgatgaagccttcccctccgtatctggggctgttacttgcagcaactgggaacctgaatgcctacttgcaacagggttgcaaactgtcttccaggtaaccagcttactgctcttagcaataaaccaagatgcatagttattaatatcttagggtttcttacaaaaattaataccactatagaatttttaaatgtgaagaatcagtttttttctcttaaacataattttcttctctttgtgaaaatgatttaatcacacctacggtagtaatgtgtcagctttccaaatcgtgatgacactgggtattattttagaaatttttttcattttgataagtgaaaagattgtcttttgttgattctttgattaatatatatgaatttttatatgtttattggctgtttgttttatgaatagtttgttcatatcttttcttcattttggtattgtattattttccttactgattggtaagctctttatgtataaaggtcattaatcctttgttaggctgcaaatatttttcaaagtgattttgctttccttctaaattgttaatggtagttttgttctccctaaagagtttagtccttttttatgttttttaaaaatgtatgtagtcaaatattttacttttgtggcttctgcctttactctcatgcctaacatctttccttatggaaagattatataaataataacccctgtgttttcctctagcatttttctggtttcaatttcatagtttaaatctataatctatatggattttattttcagtgaaacctgtgaggttgggatttggctccctacttccctgccaaattgtcaacgagttgagtaatttgactttgtttcagggatttctattttgttccattgatgattttatctcttacacctgaacctttgccatccttttcattttcatagcattattataaatcaggaccttatcgatcctactcccaccattattaacatgtttagtgtgttttgctattcctccaggcaaactgttatttatttattattttcttagagataaggtctggctctgtcacccaggctggagtgcagtagcacaatcatagctcactgcagccttgaactcctaggctcaagaaatcctcctgcctcagtctcccaattagctgggactacaggcacacaccaccatgcctggctaatttttttaatttattatttttgtagagacaaggtctcactatattgtccaggctggtcttgaattcttgacctcaagcaatcctcctgccttgacctcccaaagtgctggcattataggtatgagccactgtgcccagcctgtacaatgctttttaaaaatcaagtttgaataaaaaattccttagggattttaaaattaaattaaattaaattaatttatttatttatttagggacagggtcttgctctgttgctcaggctggagtgcagtggagcaatctcagctcactgcaacctccacctcccaggttcaagagattctcctgcctcagcctcccaagtagccgggactacaggtgtgtgccaccatgcctggctaatttttgtattttttagtagagacagggtttcaccatgttggccaggctggtctcgaactcctgaccttaaagtgatttgcttgctttggcctcccaaagtgctgggattgtaggcgtgagcctccgtgtcccgccaaaatttcattacatttcaatactagtttggggagagtttatttttctttcttctcatccaaggatatcgtacctaataacttgaaaagcagaagcaaccatccagaatatcatagactttggtaggggttattaccacaataaccagatatatgttgttcagaagattaccactgccaaccctcattctggcaaacaaccctcgcagtgttgctgttgagggctggcaggatctgtgtgtggtgtgcacgtgtgtgcttgttacacaaccctacttatttgtgtcattacctgctaggagaagctcacagctctctagcatttcctttcaccatgtgttcatatgggaacagcttcacataatttgcactttgggcatcttactgtattgatgttcacccctttcagtgcactgactttcaaactgtgctctcggagctggagtctgggctgctgcgggagcaggccatgggggctctgggctccttcctgcttcagctgagcagctccactttatctggctcatgtgccatggttctgcaagagagatttcatctgaagaagagcttcctgtgttctgagactgcacagcttatgccactgattggacatcctaatgtggtcccatgtcagatgtgggctgtgaccctttgcagccgttttacaattcccgttattttagattctcacactgaaaggaaggtgatagtgggacaagttagatggctgggagaaataactcacttataactatctggctgtttgcaaataccaactaatatacaaatcctgtctggctcgtgtggactgcccacctgtgtgttgtatggcctgccaattcccgcatggcgggtggtggtctctgggtagagcttccagcggggtgtggtggctcacgcctgtaatcccagcattttgggaggccgaggtgggcagatcacctgaggtcaggagttcgagaccagcctggcgaacatggtgaaaccccgtatctactaaatgtacaaaaattagccagacgtggtggcacacgctgctgctagggaggctgaggcaggaggagcgtttgaacccgggaggcagaggttgcagtgagctgagattgcaccactgcactccagcttgggcgacagagggagaccctgtctcaaaaaaaaaaaaggcttcctagtagtttctgaaaaaactgactgattgctagtgactcctgagtgagatatagtatgtctcagagagaaggaaagacctcttaaccaagctctgatgctggcattggaattatagctgactagtaggcttccatgacactgagggaattcctacgtgtatcaaccacaaattggtacattccttaaggacagccagcatcttatttatctttatctccctggctcccttacacacaggggttgtttattacccattaaagtaatgaatgcaggtagcaggggagtcaaatcttgacacatttcagagagttttctgacagagggtggtgactatgaattaatccagtgacagacaccaggattccagaggaaccttgcacttcaactcctctctgcccagctccatgagattagtgagctttgaaaagcaaatgactactctgatgccaggctctaatgtgagctgagttggggctgtatttctgacaaacaagattactgcttgtaatcaaccctaaacaatgtgacaaggaatatgaacactagaataatgacttcctttcccagaagttggcgctgatgatattcaattgtatggcacgtgtacggccaatgtctttaaagcatggagtgtaaaaatccttgcctttgagttaagcgtacctgaggtgtaacctccgcattctgcctagcggagaatatttatcttttagggcctgggaagttgcagtaagactattattttgggatttacagctagtgagctaaattctcagctacttcattatctacagaatggcagcagttaggaagaccaatttcacctggttttaggcttgtagtgggcagttcaagggcacaatagcttcaggacagtattttttaggtttttatgagctatttaaaaatacatgcaaaatcaaaataagagtcttgtttagggggtccccccaagactgcccacactttggtgatttgctgaaagtaatcagaatatagctgtactcatagctaatatttatttatttatttatttagagatggagtttcactcttgttgcccaggctggagtgcaatcatgtggtcttggctcactgcaacctccacctcccgggttcaagcaattcttatgcctcagcctcccgagtagctgggattacaggcacccgccaccatgcccagctaatttttgtatttttagtagagatggggtttcaccatgttggccaagctgggcttgaactcctgacctctggtgatccgtgtgcctcgggctcccaaagtgctgggattacaggtgtgagccaccgcgaccggccttatagctaatatttattatggtggcaaagtaaacatgcacagcaagatcagtaatgggaaagataagtggagtctggagaaattcatttgcacgtttcctatgatctctctcctgtgataagtcacgtcgagttcgccttccttccagcagtgaaaatgcaactatgcctatgtgatgtttctgcccagatgagccagtttgaggctcagagtttagggatatttcgagggctggtcacataggcattttctacctagcaaccaccaaaattccagatgccagagggaaagcaggtgttcaccatagatcacattgtataaacagcctaagcccagcaaaatgaccttatcagttagtaatggagcacacattccgaaagccatgttcccggacaccagccaagaactaaccctgcaagcaggccctttgaaagatagcagcctcaagcctgctgttaactctttttttacacgagtctaactaacaaaccattttgaaaataaaaaaatcaaatgggaaataatggtccattaaataaatcattgcaattctttgctgatctctctcctctggtgtctaaacaatttgtctcacgtataaaaggcaaccacaaatttgcatggtcttgctgacacataatgtaaaagaatgagactgcttcatgtaattataagaaatacatttcaggagaatatgaaggtgcttgtaattgcaagttttctttgtttgtttgcttgtttaaatctagaaacagagcatctaatctctttctggaattcctttttttttttttttgtttctcaggctggtctcaagctcctgggcgcaagcaatccgcccaccttggcctcccaaagtgctgagattacaggcatgggccaatgtgcctggcctgaggcctagaattccatttttaagtaaggagagaaggatcagagtctaaagttcatagattgttttctagcatgtgtgtctctgtggctgcctgcaaggctcttgggagcaatcactacacaccaagtttaggcacaacttccagtttttatttgtcagatcagagtaaaactctcttccttggacagtgcttgatgtatatcagaaagcaaaaacttagatggggttcagtttgcagttcacagaaatgcagctttttgggaaacatatttttaagtataaaaccagaatcttgagtcatttgagtagcattttattctagttttggaactttggattccatgtctccatccagcaattactgtctcttgtgcagataaatcatctttttgtggcaaaacaggaagcagcgtggtacaaaaacaacaggagggaaaggtactcagtgattcactgtatttgcttgactgtttcagaccaaacccaaaagccgaaactactttgtaataagagagtctttaaaggaagtacacacctgaagccagttccttccgtttcctctttcctttgtgtgcccctaggatctaagtccattctctcctctgtgcttagcccttccctctatatttgttgagtcctggcaacagtcagggtgagaaggaacccatttcattcaccattgtctctggtctctcttctgtgacaatatatcggggttttttcctgctaagtaacatgctgacttctagcctgggatggttttgttttctgttaacttctacatgtagcattacagaaaatttagaaaagagagagagagaaaaaaaaagcacccacaaacccaccagcctaacataattactgtgctcattttcaaatatttcctatgagcctatacctgtatatgattctttctgtggctgtaataatagtgagtgtatctatctatctatatagatatatatacacacacacccacactcttttattttgaaaacttgcaaacctacagaaaagatgaaagagtgatacagtgacggtctggagatctcctttgcaaaggaacatttttctccattttggttttatttatttatttatttatttatttatttatttatttatttttgagacaagtctcactctgttgcccaggctggagtgcagtgtcatgatctcggctcactgcaatctctgcctcccgggttcaagcaattctctgcctcagcctcccgagtggctgggattacaggtgcccgccaccatgcccggctaatttttttgtatttttagtagagatggggtttcaccatcttggccaggctggtcttgaactcctgacctcgtgatccacccgcctcggcctcccgaagtgctgggattacaggtgtgagccaccgcgccaggccattttggtttttaaataccaaaaatttgaaatgaactagggctcctggaagtaatggttgattccaggactggggcaggaaaagtacaagatgagcctggaacatattgctgtatttaaagcaaggaacagctgaaaatgaaaggggtatgagttttccaaggtcaaagaagccagcttgaaagggcacccactggccttattttggacaatttgaacatcaaaaagaacaatgacagtattagattataacacatttcattttctgaaattccatgagtccataataatactaagaaaatacaaaagcaaagaaaaaagaaaagccaattaaaaatgtagatgtcatctctgatgtaataatggattcaaataaggatcatcagtggatgctaaagccactgggtgaaatttgtaagaaacagaatattcatatgttttcagaatagcaccataaattctttattaattacagaagtttgtattttgaacttaacacttcatatgcatttttccaagttgcatgaagttcatttttaatggctgcacacttcaccattcactcaacacaccccctatgttaaagcttattctatcccagccactgtgctgggtgcttgaataagtgcttaaataagaacatgttccctgacctggggactcatcaggtagtataactgttctctaaattttgggaggtgacagacttccaagattgtgatcaaagctgtgggcccacttcctggaaaactgcccaaacataccactttgtagtttccttacattcatacccccaatgctacccccgtcccctgcatccatagactttcttctaggggtcttcagctacagaccttcccatccaggaaagggcacagacctgcaagcgcacagtcccagcagtgtgggaaatgctggcattagagcttgttctctctttcgtggttgtacccagggaatgctcccaggttgccaggattaactaacattaagattaatatcttcctgcaagtggtaccatcacccacacagtgtgacctggctggactcccctggggaagctcagattcctcctccctcatccccattgctcatagtcagcaggtgctggcaattcctgttgttggaattcactccatcttttgtctattttctgccatgctgcaagggagtatggcccggagtcaggactctagctgtcaaccgagttcaaactggctcttttacttcccagctggctgtgaccttgctcttctgtgcattgctttctttataaaaaggggatggtaatagtccccacttgacatggcagaaatgaagattaagtttcacactaaatgtaaagcactgagcgtagtgcctggtctatggtaggaacttaaatgggaattattatgatgatgctattattattacttttcctttagttccagtatctatctcttgcctactgcaaagcctcctacttggtttctctgcctccagcttgcttcctcccaatccgtcttctgcggttggaatgatctccccacattattttggaacttaaacccccccccccccgatggcttcccttggtttataggataaaatgcacacaaatccatatggaacagcttgcagttccctgaactccccagagggttttgcctgttgtgtcttgatacacattcctgacctgcttagtgagaggggaatagggatctatatcctattagaatggttgttcacggactcgttaggtgaacaaggtgaatcggaggtgacaaggtggcgaatcggaggtgaattattaggtgaattgcaggtgagagtggctccctccattgttcacagagggtgcatttcactctcccaggcatgcttctcttacgttgcgtggctctgctctctcttggacttggagagcaaggtactcttttcccttgcacaaatccgacattctgtttccagcactgcttgaaacttggaatcgctttgtttcaaacttggaatcactttgctttttgactttgagttgcatggttgatgttgccaggggccattcttgcaccatgtggtgcaaaaatattttacttctgtggggacactattgacaagtagggtagatgctatggattttacttctgcgtctgctgcttattgagtaattttgtccaagtcactactcctaaacttgctgattctcctccttagggccgctgtgagggacagttgaggtggtgctttataaactcaactgctatcaaaatgccactttccccgctttgttacacttcaagcaaaagtgaactgaaattaacaaaagattctattttgctttcttttgaactgttcttttaaacattttagaaaaccattcacccctgtgattgtttgacttcaactccataccttgagatattttttagggtaaattattgttaatgaaccacatttgagtacaccttcccttggggtgggataaacgttggttaaaaggtgcttttaaccagatcacggtgcactgcagtgtggatggtgtggtgccagacacgaatggaattaatagtactacagactaccgtgtgcttttaccaccctgcctgggtggtattctactgtttactatgaaatataaaactcattcaaagcagactaagtttttgttccattgttcttatattttatggcttccaggggccctttatgaaggaaataagtatagtagtaatactgctttggggaaaactgtgttcatgacaatctgtttttaaaacatgctgtttcacaggaaacggattttaatataaagtattgtaaggaactcatgcatgctgggaatcctaactatgccattaaaatctttaaattccaaccacctctttctgttaatggagaagaaatggtttaacagctgccttggggtagcgtaaaggtgggctatatgaggcattgctataccctttccctagcaccttggaatatctgttttcttatgttgggaatttattgggagccagaagtccttgacaagcaaacttcactatgacaaacctttcgtttgtcaagagccacatgttggctgggcacagtgggtctgtaatcccagcactttgggaagccgaggcgggcggatcacttgaggtcaggagttcaagaccagcctggccaacatggcgaaaccctgtctctactaaaaatacaaaaattagctgggcatggtggtgcattcctgtaatcccagctacttgggtggctgaggcacaagaatcttgaacctgggaggcagaggttgcagtgagccaaggtcacaccactgtgctctagcctgggtgccagagtgagactgtgtgtcaaaagaaaaaaaaagggggggggtgccgggtgcggtggctcacgcctgttattccagcgctttgggaggccgaggtgggcggatcacctgagtttgggagtttgagaccagcctgaccaacatggagaaaccctgtctctactaaaaatacaaaattagccagacgtggtggcacatgcctgtaatcccagctactcgggaggctgaggcaggagaatcgcttgaacccaggaggtgaagattgtggtgagctgagattgcgccattgcactccagcctgggcaacaagagcaaaacactgtctcaaaaaaaaaaaaaaaaagaaaaaaaagaaaaagaaaaagaaaagaactacatgttgaccattgtggtaaagtcttgtcagtatagtgattcctctgtgttgctgctggtgattttggttttgtcttgcaagaaatggtaccataaaatactttttaaaaagagagttttcatgatttgggaggcacacgcatgcataagagatatttgctgtgattttcattaatggtagatagacctttaaaaaaaacttttggccctttatttccttctcctgtctaattgccctggcaagaacttccaacactatgttgaataggagtgatgagagagggcatccctatcttatgccagttttcaaagggaatgcttccagtttttgcccattcagtatgatattggctgtcggtttgtcatagatagctcttattattttgagatacgtcccatcaatacctaatttattgagagtttttagcatgaagggttgttgaattctgtcaaaggccttttctgcatctattgagataatcatgtggtttttgtctttggttctgtttatatgctggattacatttattgatttgcgtatattgaatcagccttgcatcccagggatgaagcccacttgatcatggtggataagctttttgatgtgctgctggattcggtttgctagtattttactgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccaattcctccttgtacctctggtagaattcggctgtgaatccatctggtcttgtactctttttggttggtaagctattgattattgccacaatttcagctcctgttattggtctattcagagattcaacttcttcctggtttagtcttgggagggtgtatgtgtcgaggaatttatccatttcttctagattttctagtttatttgggtagaggtgtttgtagtaatctctgatggtagtttgtatttctgtgggatcggtggtgatatcccctttatcattttttattgcgtccatttgattcttctctctttttttctttattaatcttgctagtggtctatcaattttgttgatcctttcaaaaaaccagctcctggattcattaattttttgaaggattttttgtgtctctatttccttcagttctgctctgattttagttatttcttgtcttctgctagcttttgaatgtgtttgctcttgcttttctagttcttttaattgtgatgttagggtgtcagttttggattttcctgctttctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaccttacaagggacgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatcccaatcaagctaccaatgactttcttcacagaattggaaaaaactactttaaagttcatatggaaccaaaaaagagccctcattgccaagtcaatcctaagccaaaagaacaaagctggaggcatcacactacctgacttcaaactatactgcaaggctacagtaaccaaaacaacatggtactggtaccaaaacagagatatagatcaatggaacagaacagagccctcagaaataacaccgcatatctgcaactatctgatctttgacaaacctgagaaaaacaaggaatggggaaaggattccctatttaataaatggtgctgggaaaactggctagccatatgtaaaaggctgaaactggatcccttccttacaccttataccaaaatcaattcaagatggattaaagacttaaacgttagacctaaaaccataaaaaccctagaagaaaacctaggcattaccattcaggacataggcatgggcaaggacttcatgtgtaaaacaccgaaagcaatggcaacaaaagccaaaattgacaaatgggatctaattaaactaaagagcttctgcacagcaaaagaaactaccattagagtgaacaggcaacccacaaaatgggagaaaattttcgcaacctactcatctgacaaagggctaatatccagaatctacaatgaactcaaacaaatttacaagaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagatatcatctcacaccagttagaatggcaatcattaaaaagtcaggaaacaacaggtgctggagaggatgtggagaaataggaacacttttacaccgttggtgggactgtcaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacagtagcaaagacttggaaccaacccaagatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccacatattctcactcataggtgggaaattgaacaatgagaacacatggacacaggaaggggaacatcacactctggggactgttgtgggttagggggaggggggagggatagcattgggagatatacctaatgctagacgacgagttagtgggtgcagcgcaccagcatggcacatgtatacatatgtaactaacctgcacattgtgcacatgtaccctaaaacttaaaagtataataataaaaaaaaaaacaaaaaaaaacttttggcgaggcatggtggctcacacctgtaatcccagtactttgagaggctgaggcgggagtattgcttcagtccaggagttctaggccagcctgggcaacatagtgagaccccattcctacaaaaaataaaaataaaaggttagatgggcacggtggcatgtgcctgtagtcccagctactcgggaggctgaggtgggaggatctcttgagcccagaggtggaggctgcagtaagctgtgatcgtgccactgcactccagcctgggtgacagagcaagaccctgtctcaaaaaaaattttttttaaggaaatgacaaggaccattgcatggtgactgtagtttgctttttaaaaatcattattcatttgtttttagatcagtactatccaatataactttctacgctggtagaaatgttctataatctgcactaccatatatggtaggcactaggcgcacatggctactgagcacttgaagtgtgacaggtgcaaatgaggaatggaattttaaattttatttcattttaactgatttaaatttagatagccactgtggcttgtggctaccatattggacagtgcagtttaaaaattttcccctcttcttgggaggccgaagcgggcagatcacttgaggtcaggagtttgagaccagcctggccaacatggagaccctgtctctactaaaaatataaaaaattagctgggcgtggtgatgggtgtctgtaatcctagttactcaggaggctgagacaggagaattgctttaacctgggaggtggaggttgcagtgagcccaaatcactgcactccagcctgggtgacagagcgagacacactatcttaaataaataaattaattaaaaatttcctctcttcaaatgtaacaagacacatagggacatgtctgtattttataccacttcataaaatttaacatgcaagactctaatatatgataattcttccctgtgagaaacgtgtgtgtgtgtgtgtgtgtgtgtgtgtgtaaaagattgctgaaaaagataggttagtcctaagatagagctggatatcttgaattaaatgaaaatatacccagacacatctagcttatgacttaagtttgttctgtgtgaaacagaaatgaacccggcatagagtagcgctcacggcgcatatgcagcacagagtgcactcacattttattgcatgtgcaagagccactgttggtctgcattcagatgacccacattttatttctagcagttgttttttattggcagatgaacgtcctaaaatcagcaagttcagcagtaacgtatattttgataattgtgttcttgagtgtcatggtttgttttattgtcctaccgccagtctctgaacatatgaaagacaattagtgaacccagtcattaagcttggagatgaataaattcaagctgaacttcattttgttaaactcagcctgtgccatttggatgtgttggcagagcttggggcagacagccatcagataggaaatgagagctgttagattagaaacaggcccgcccaagtccacttgctaatgtgggtaggaaattatacttggcataggaaacaatcctgaaaatcatacacttagcagtttttattggttctttatgtttccatgactgtttgaggagataccaagttatgaatatataacccctatcaatagcaacatcttatgtttttatatagttttcagagcaagtttatacagtttcttttgactctcaaaacattttggtgagtttggaggtattattgccattttttctagactcagaagtcaatgacttgtccaaaggtacgtggctcataaatagtataaccaggagtgtggggggaagatatgagcccactgtattcttccccaggcttagagatggggaaggaagtgggtgtaaaatctggcacgcaaggaaatgaagttccctcagtcctttggcccttgtcacttgcgttaggggacatgccctagtgggtcctgctgccctacctgtggcacagcttaaaccctaccctgtgccccgagctagtataatggggattctggcttcaccttgaaggatctatgtgccaagtaagtcacttgaacgtccttgaccttcatgtcatctcagataggaagttgagtgcaacttccaaatcccctttcttggctaattctatgacacaaaatgttgcatagaacgaggaaggagtctccatttgagcagggagagtgcatgaataggatgtatcagcttttttggctgttgttttttttttcctccaaatattcttcagttattcctatgtaccagtagaagggatttctctgaactaaagtctaagtaggaggtatctttctacttgattggttttaaggatatgttgttttatatgtttatctaacatatgttgtcttttctgccagttctgaatcttctatctcctctccttattctagtgctccccccacccccgccaccacctacgctgtttttgttcaaaagccagagaaggaagtgagcatgcaaatcaggaaacagattgtctttttgcctatgcagatttgtctgtgattttgtttatttattaatattcacttagcatgtttagagtaaaatcttccttttctagtctatcagcatagggtttctccaattgttccctttcctcaaaaaaaaaaaaaaaagtaaaatttcacctgttagggaattcagactttttttttttttttttttgagacagagtcttgctctgtcgcccaggctggagtgcagtggcgcgatcttggctcgttgcaagctccgcctcccgggttcacgccattctcctgcctcagcctcccgagtagctgggactacaggcgcccgccaccacacccggctaattttttgtatttttagtagagttggggtttcaccgtgttagccaggatgatctcgatctcctgacctcgtgatccgcccaccttggcctcccaacgtgctgggattacaggcgtgagccaccgcacctggctgggaattcagacttttattgctataaatcagcaaaagtttggccaagactggggatgggtcaggcatgaaacatttccttgtaatatcatctccatagatcagtagaactctagtggagtagatcagtgtgctgatttatttggaactgagtaaaaggaaccacaaacagaccccacagctcagagtgaaagttgagttgcagagctatctcatggggaaggggtatttctaaggcaacccaacctggcgatatttgtcaataattggtcctattttgaatactttctgtgactcaaggtaatcagggcattccatatatttctaattttgaaatttgcataattgtgaaaattatttctccaactcttggacctatgagaatgttggaagggaaaactttcacgctgctgacctaaaatcataatgaaaacatgatctgaaggagataacatttcaaggcaagtgtagagagtgcgttaacattttttatgtcactgcagggtgttttctgggtcttgagccaatatgcacgtcttagtcctcatgaccaccaagttcaagctcctgtgcaatttgctgatcgtagatgactagttcctccgtaatgaggaggtgctgtgattctcaagcacggaggccagcacagatctggatctagggaggtgctgtggtccttaaaacacagagccaaaagccaaactgcagctgaaaagaattacagcatttcgctaatgtaatcagggatacacagctgtgttcactgttctctagtcctttcatgttgctagaggggagaaaagatagtttttcctctacccatcataggttcatggccaaggccctgataacaaaaaaacagattaacaagcaaaaagcatacagttgggcacagcagcaggtgcctataatccctgttatagcaggtgcctataattccagttacttggaaggctgaggtgggaggatcccttgaggccagtagttggagactagcctgggcaacagtgaggcaccacctccccacactcacacacacacacactccagccccatttcttaaaaaaaaaaaagagacagagaaaagcatacaaatttatttaatgtaagtattatgggaaccttcataaggaaatgaagattcaaagaaacaggtaaactctggtctttctaaaacagacctgatgaagagtagagagtcatggagagttataatagagcaaaaagagtgtgatctcatggtaatatagtaggggaacttagcaaggcctgtttattcagattcttccctgggatcctgtgtcttcagagataaggatactcgtttcctctgggtatgggggttgggggtacctctcacctgagggccttttgacctgcttggagaaggtcagaaaatccttccggggtgttatgacctgcttcagtgggggaaggtcagaggaaggtcagagagaacttcttgcacatgctgtctcaaattccttccgcttcatgcaatgtatatgtgggggctgttatggttagagtcataatagtctaggtcaggggttgacagactttttctgtaaggttagagagtaaatatgttaggcttatgagccatacgcaatatgccaagatgccatattttggggtagtgtgtcctgaactccctcattgccaaaggaaacagttgtcatcagaagaatgaagaatgaaaaaaacaaactgaagatccaggtaatatcgtatgctatgttattacattgaagaacaaattgacatcagtaggagtaggactaagtgatgctcaacctcagatggactgaggtttagtccctagtatgacaagagtagattcacagaaaataaatgggtccatcaactcaggctttcattttaaatcagtttgttaatataacacctctagtagaaagcaagcaatagttaaggtggcaggaaggcaatctactttcaaggcttttattaaagtttagaaatgatcagtggtcttcagaagattataaatttcagtctaaactgaaatgcgtttttaattttctgaataagtaacttccagtttacgatgaaaataagtgatcagtttctctgaccaaagaaagaggccattgcatgtgattggactgacctcttcctgtggtgactagaaagtgctaaaagaatattctttagtattttctctcatactaaggggttaatatggaatgtgtttgaaattgcaaattgaataattgtccaggttttttttttataccttgctaaattagttcctcttttaatctagtgatagatacagtgatgccagtgatgacagcttttcagagccaaggatagctgagttggaaataagctgaaatgaatacatgactgggaataatggggactgcctgtgagggtaagatggaatcttcgaggattgttcatttctctcatggacaagctgtcatcttggtatagaggcgggtattataggactcgcctcacaggatcttgcccctttgagatactcccatttgactggcacagttagcaggacacgcatgacagcccatgacagagttagtgtttggggaaaatggaatgcaccttgggccaggaaaaaaaaaatataagtacacctataaatgtatatgtgggggctgttgtggttagagtcatcatagtctaggccaggggttgacagactttctgtaaggtcagagagtaaatatcttaggcttatgagccatgcagttcctgcggcaactactcaattctgctgttgtagcaggaaagcaaccatagacaatatgtaagtgaacaagcatggctgtgttccaataaaattttatttacaaaaacagtttgctgatccctggtctaggccactcatagaagagcagatttccttggatttgtataaaataaaattaaaataaaataaaacataaaataaaataaaataaaatagtatttgatttctttgtagggagatgcaagagacaggcttagtgtccaagggcagcttatttttccattgctctattatgcactattagagagaataccagcctggatagcttcagtaaatttatgctcagtggcagatagtgcctggattgccctaggcattatggcaggccttgacttgtataagctgttctttagcagagacagcagcttttggaagacttgtaaagtgttcattgctttcctgtgaggtctcttcatgtttatcagggaagatgcaaagctgtgtctatttagttttgcctcaaacatggagaccctttggagcaagccaaaatggtgcaaaggttagctggagatattgaaagacttgtattattcagttcctggtgttgctaatatttatattcttttcttttaagcctctgaaataattgaaggcaagatgaaggaactatctgaagaaatcactacactcttagagaatccctctgttctccagcaaacatgggatgtaaagcctcacagggaatctgataatacatacttctgtcaaccagaaccagaggggtagttttcttttccctccagaggcagcctttggtacttaaaatatctgtagctgattaaatttttcccaacaacctcactggggagaaagtgtgttcatgttttgtccagcggatcaggatgttaggatgacgagcaagagtccaggtcactgtgcctttgctgtgttgtatggaaaggatggcagggaacatgctgtaagtaattttgagtaagaaaatgagtcactgtgttacctggaactcagccacagatttgtgtgtggtccaagatcattgcagtttctcaccctgtttatttcctggtaaaagtaaaattgaataggtccaagacttgggggtggcaagtaaggctttgcctcaggcacaaaatttaagggggctccaaaaaactcaggaatcaagatcagcaatacagtctgagtatcccttatgtgaaatgcttggggctagaagtgttttgaatttcagattttggaatatttgcatatacatgcgatatcttggggatgagactcaagactaaacatgaaattcatttatgcttcatatacaccttatatacatagcctaaaggtaatttgatacaatattttaaataattttgtgcatgaaacaaagtttcgactgcattttgactgtgatttctggcatgagatcagttatggaattttccacttctagcgtcatgttggcattcagaaattttgaaattttggagcattttggattttcagattagggatgctcaacctgtatatatattttttaatcgacgtgaaattcacgtaacatagaattaaccattttgaagtgaacaatttggttgcattcactgatgttgagcaaccaccacctttaactatttccaaaacattttcatcactccaaaataaatgcctgtacacactagcagtcactccctatcttcccctccacctgtccgctggcaaccactgatctcctttttatttctgtggctttttctattctggatatttcatataagtggaattacacaatatatgtggtcttttgtgtctggcttcttctgagacagtaggaaggggggcttggctttggctcacccccactagagcattttttcatgcattcccactgatcacaaaacccatactactacctcattgacaccatacctgctaacctcgaggctttagtcatacaaagaaaatggcctttctgtattgttcttctgtgctctcataatgcttaaccatgtcttttacttaaacaattccaggaactggccttaggagatccaaatagggaaccaagattgcagagtgtcccatcttggg

SEQ ID NO: 5513 - DNA, 74114 bp, human
aaaggcaggcattctctttccttttccttctctcctgagcgctcctgcagttcctggggcgtagtaggggatccacaagcgtttgtgaccagtgaagttctttacaagggtgagatctgcacgggaggacccgagcgagggtctcggcttgccaggaagccggggttccccgggaagcgtggagttcacccgcgcactcgaagtgcctttgcaaagtgagccacgggagggaggagcggtccccgggctgggcgaggcctggggcccagtgcgtccagagcggagggtgacgggagctgcctgtgctggaggaatcactttttaggcgcttgttttggaccattgcacaaacccgggtgcaaaccccaagctcaccagcgtgagtgagctgggccagcagcagggaggagaggggaaggtgggcgaggagggcgccgcgcaccccgaggcccgtgtgggcggtgggaagatcccgggggcggctttggacagccccggcagcgaccccttccccagcccgacaggtgagcgccaggccagccgcggggtggagcccgccgtgcccaccggccaccctccccggtgctaccaccaccgcgcaggtaacttcccttctgggcctgtcccagacccccagggcctcggcgcccgggccatccctcgtccccagggcctctccgccctgcacccccagccccggtgcacttgtggggccgggctcctttgtccgctctctgatggcgccggctccctgcccagcgctgagtcgggtccggccgccagccccgcgctcgcagacctcggctgccgggtgtggcgcggggactggggaacgctggcccgtgcccagtgcggttggagcctgtcccgcgcgtccccgggacgcgcttcttcccgcctccgcccgcgccagcgcccgcacccggatccccacttctcccggccctcgggagccaggagagccctgagatggcgttggcggaagtgaagccccgagcgggggtctgcgaggctggtgatcagcgccggtaacatggcctttctgtcctctccccggtcccagtgcaccccttaaacaacgacccccgcgttttccccgtactagatggttagggcgcatagtgccgaactacgctgctgctacagaatagcttttttgggggcaacataaaaaagaattgtatgtatggtttatatacaacaaaatgtcccattttcagtgtgcaaatcgacgggatttgacaaattatacactcctgtaaccattatcccaaagtgaacattgaccatttccttcaccctgcaaagttccctggtacctcctttctgtcaatccaccccaggccccgcactcaaccccggttctgattgttatcatagcttagctttgactgttctagaacttcatagaacaagatcatcaggtaagtactcttttgtgtctaacattactttttaaatggccatcactgagaaggtgtctctgggtgcttccggtgcttttatttgctctaggcctgcctggtctaatgtgggagccactggtcacatgtggttattgaatactggaaatgtggcaaaatccgtactgagatgtgctctgagtacaggcacctgatttctgaaagcttagtacacaaaaaagatgtcaaatatctcactaatacattcttacattgtgcgttaaaagtgataacatttttggctacattgggttaaataacatatattaacatgaacttcatttgattctttttacttttttaatatggctactagaaacttaaaattacgtacctggctgtgtaatattttttattaggtagtggagacagcacagctctacactgtgctatcctataaacacttggttctgctcactgcatgtaagagtaaatgaaaaacttgtcttgacaccagaaacaatcctcaatggaggaagtgatctaaaacagggccagcctttccctgaacctttgaaactttgttaaacttacttgtgtgcttaaaagaagtagagggccgggcatggtggctcatgcctgtaatcccagcactttgggaggccgaggtgggcggatcacgaggtcaagagatcaagaccatcctggacaacatggtgaaaccctgtctctactaaagatacaaaaattagctgggaatggtggcatgcacctgtagtcccagctacttgggaggctgaggcaggagaattgcttgaacccgggaggcggaggttgcagtgagcccagatcgtgtcattgcactccagcctggtgacagagcgcgactccaactcaaaacaacaacaacaacaacaaagtaggaagaattaggtgtccccttggtattaagttgcatttttacaaaaggtctctaaaatatccaaggtgctttaaaaaggtatcttgtgtttttgaaaaaacagaaaatgagcaattgcttatgtaggggaggaaagagctgatatcataagggtcacggctgacagccttaaacaagagacagattaacaagagagaagcataataatttattgaatcataggtttatgtgacatgggagccttcagaaatgaaaaccccttaaagatgcaagggaaatgatctgattttatgcttggagtccatgaagcagggacagatgagctaatggaaatagactgagtggggaaacccagcaaagcctgtccacattcttcttggcctctctgttgtagcgtttcttcctccccagtatggggtaggacctctttggaatgagggtcttaatttctttatggccagctgttgtatagaaaggtggttgagaggaaggttagagtcatattttttggctttatggctggctttggggggaaaagggttctagtttctatgacttgccttgggggagtatgaggggtgagagacaggagggcaggagaaggtcagagagaaactttgcttctgaggccttcatttttgggttttgttttctgagccccaacacatacaacctaatcacctaaatatattaagacataacatggtgtatctttgaccaaattaagatagaaatctgtttttttttttttttttttttttttggagacagagtctcactctgtcaccagggtagagtgcaatggcacgatcttggctcattgcaaccttcacctcctgggttcaagtgattctcctgcctcagcctcccgagtacctgagactacaggtgggtgccaccacgcctggctaatttttgtatttttagtagagacaaggtttaaccatgttggccaggatggtcttgatttcttgaccttgtgatccgcccgccttggcctcccaaagtgttgggattacaggcgtgagccattgcacccggccataagatggaaatcttagtggtgacaaataaaatttagatcttagtttaaaaaaacatagtcaataatatattcaattttatagtctgctctctttttcaggtaacataagcattttctttcttcctttttttttttttttgagacacggttttactttgttgcccaggttggagggcactggcacaatcttggctcactgcaacctccacctcccaggttcaagcaattctcgtgcctcagcctcctgagtagccgggattacaggtgcacgccaccacacctggctgattttttgtattttagtagagatggggtttccccatgttgcccaggctggtctcgaactcctgagctcaggcaatccgcccgtcttggcctcccaaagtgctgggattacaggcgtgagccaccgtgcccggccacataagcattttctttttttttaacttttttttttgagacgaagtctcgctcttgtcccccaggctggagtgcaatggtgctatctgggttcactacaacctctgcctcccgggttcaagcgattctcctgcctcagcctcccaagtagctgggattacaggcgcctgccaccacgcctggctaatttttgtatttttagtagagacagggtttcaccatgttggccaggctggtctcgaactcctgacctcaggtgatccgcctgcctcagcctcccaaagaagcattttcttatacaaaaatttattaggcataatgtgacttgtacgaatgtatgccagttttcttcaccatacctctacggcatttttccatttcggtaacttttacaaagagagtcatttgaacagtataacagtgccagaataaggtataattaaagcacagtttatttgccccttaatcctgcaggaaaggtgaagtccagtggaacatagaccttgtctttttgtttatctccatattcctaggacttggaaatatgtcaagcatgtaatagatgttcaaataaacattatatatgtaatatatgtatatatataatttatttatttatttatttcagacggagtctcactctgttgtccagactggagtgcaatggtgtgatcttggctctgggtttggattgacaatgttttaagctataaacataggtcagataggtgggtgccctggtgactagtgaagatgtgcgatggcattgaatgtgatcaactgtgttgtgtagagaaaggtaggcccagggacttagggaggccatctgggatggaacatgtatattttgaatagcttcagtttactcagcctgaccatggtcagctagttcaaatggaattcacagctctgacgtgtgataactttagttaagatagtttgttttgaaaggtaagcagaggaaaccacaaaatcagaatgggcattcctttgaggaggacaaataagaagtgggtaactgaaattgttcctacccgaatgcatttgtgctgaatttccaagtatgtaaaaaaattgtgaaattacaaatgaaagtgaaatttatagttattaccttttgttagttactgtctctctctctctctctttttattttttcttttttggtaccgagtctcaccctattgtccaggctggaatgcagtggtgtgatctcagctcactgcaacctccgcctcccggcttcaagtgattctcctgcctcagcctcccatgcagctcatgtagctgggaccacaggcacacgccaccacgcccggctactttttatatttttagtagagacattgtttcgccacgctgaccaggatggtcttgaactcctgacctcaggtgatccgcccgccttggcctcccaaagtgctgagattacaggcatgagccaccgcacctggtctctctttttatttttgagacaggatcttgctttgtcacccaggctggagtgcagtggcacaatcacttggctaactgcagccttgacctcctgggctcaagcaatcctcctgcctcagcctccccagtagctgggactacaggtgtgtgccaccacacctggctaatgttttatttttcttttgtagagagggagtctcactatgttgaccaggttggtgtcgaacttctgacctcaagagatcctcccacctcagccttccaaagtgttgggattacagatgtgagccaccatgcctggcattatttttctttttctgtaactgtaattttatattgtggtcttactcagttgcccatttgcctgccatgagtacacaaataatactgtttatggtctactttcacatacatggtgaaattacaagagcagaaggcccctgtacacactcaagggaaaaacaatagtactcaaagtaaagaaaatcaagttattgggcttcctataaaacaaaagggtttgaatcagaaagcagcagaaaagtcaaataaattttccttatgactgtcaacttaaaaatcacaagatctataaatttagaaaggagactttcttttttaaaacattttcttttctttttttttttttgagacagagtctcactctgttgcccaggctggagtgcagtggcgtgatctcagctcactgcaacctccgcctcccaggttcaagtgattctcctgcctcagcctcccgagtagctgggattacaggcgcatactaccatgctcggctaatttttgtttgtttgtttgtttgttttttttttgagacagagtttcgctcttgtcacccagactggagtgcaatggtgcgatctcagctcactgcaacctcctccacccaggttcaagcaattatcctgcctgagcctcctgagtacctgggattacaagtgcccacaaccacgcccggctaatttttgtatttttagtagagatgggatttcaccatgttcgccaggctggtcttaaactgctgacctcaggtgatccacccgccttggcctcccaaagtgctgggattacaggtgtgagccactatgcccagcctaacttttgtattttttagtagagacagggtttcatcatgttggccaggctggtctcaaactcctgacctcaggtgttccgcctgcctcagccttccaaagtgctgggattacaggcatgagccattgcacctggccaaaatttttcttacctttcgagtcggagtctcactctgttgcccagaccggagtgcagtggcacgatctgggctcactgcaacctctgcctcccaggttcaagtgattctcgtgcttcagccccgcaagtagctgggattacaggtgcctgccaccacacctggctaattttttatttttagtagagacagggtttcaccatgttggccaggctggtctcgaactcctgatcttaagtgatctgcctgcattggctgcccaaagtgctgggattataggcgtgagccactgtgcctggtgactttatttcttttcttttctttctttctttttttttttttgaggcagagtcttgctctgtcacccaggctggagtgcagtggcacaatctcggctcactgcaacttccgcctcctgggttcaagccattctcctgcctcagcctccctagtagccaggattacaggtgtgcaccaccacacccagctaatttttgtatttttagtagagacagggtttcaccatgttggtgaggctggtctctaactcctgacctcgtgatccacctgcctcggcctcccaaagtgctgggattacaggggtgagccaccacgcctggtttactttatttctttgcaggctgtaacagcctgcaaaggggccatcccacaggctgggaagcacacgttttaaagagacagggtctcgctatgttgcccaggctgttctcaaacttctggcctcaagtgaccctcctaccttggcctcccaaaaccagaggcaggcactctgaaggagggttcagttttatgctgaatgggttggctaaatatacatattcaacaggttacaggaggagctatgaatattcatgaaggtggtcctgactcatgtgtattgaataaacatgaaaatagcatatgacccctgttcactttggggatggagacttaacatttaaatgaatttcagttaagccctatgcatcaaaagatctttccaggacatgaaggcacgcaagtccacagcctctgtaaactggccagagccagtccatggttggtggtcttatcaggagaaagttactcaaatcagtctcttgtccaataaaagctgtagttttgactggtgtaacaggactcagtcagtcagcatctgtgagctagatgagttgtaattattttaatattgcttatttaaaaacagtttttattttttatttttttgagacagagtctcgctctgttgcccaggctggagtgcagtgagccactgcacctggcaagacttttttttttagagtaattttaggctcacagcaaaactcagtggaaagtacagagttcccatacaccctctcccccactgctatgcccagcctccctgactattaacatcctgcacctgcagagtggtacatttgttataatcagtgaacctacattgacgcatcatttttgcctaaagatcataggtttttgttttgtttttttgagacggagtttcgctctcattgcccaggctggagtgcaatggcctgatctcggctcactgcaacctctgcctcccaggttcaagcgattctctcttcctcagccttcggagtagctgagattacaggcatgcaccaccacacctggctaattttgtatttttagtagagacggggtttctccatgttggtcaggctggtcttgacctcccgacctcaggtgatctgcccgcctcagcctcccaaagtgctgggattacaggtgtgagccaccgtgcccggcggaaagtctgtagtttatttacatcagggttcgctcttcctgttgtccattctgtgggtttggataaatgtgtaatgacatgtatccatcattacagtattatacagaatagtttcactgccctaaaattcctttgtattgtgactattcatccctctctccctcctacccgctgacaaccactgatctttttactatctctctagttttgctttttctaaaatgtcatatagttgaagtcatacagtatgtatgtttttcagattggcttctttcacttggtaatatgcacttgagattcctccatgttttttcatggcttggtagcccatttttttttaacaccaaattatattcctagagattgttgtatattttccactttacagatgaaggaataggcacagaaaggataaataacttgcccaaggccgggcgtggtagctcacgcctgtgatcccagcacttggggaggccgaggtgggtggtcacttgagaccaggagttcgagaccagcctggccaacatggtgaaatcccatctctactaaaaatacaaaacttagcccagcatggtggtgcatgcccgtaatcccagctacttgggaggctgaggcatgagaatcatttggaccggggaggtggaggttgcaatgagccgagattgtgtcactatactccagcctgggcaacagagtgagaccctgtctaaaaaaaaagaaaaaaaaaaaaaaaagaacttgcccaggtacagtttgtacagatcagtctgacactggagtctgagctcttaaacattttagcatgcctgtgaatcctagagaaatttggtttatcatgatgaagtttgttgcatgatagagttgaggtctttggaaacccagggcaacagacctaggcactttgcttgcagaaggtatctacagctttctgtatagtgacaacaataaaaagcctagaagataagactttgtttcaaaaaattcaagtatttagtttggacagaaaactgctgtgtgcttttgaaattttggtgagacgaagcatggtggctcacttttgtaatcagcatcttgggaggccaaggcaagaggattgcttgagcccaggagtttgagaccagccagggcatcatagtaagaacctgtctttacaaaaatgttttaagaattagctgggagacgtggcacgtgcctgtagtcccagccactctggagcctgaggcaagaggattgcttgagcccagaagttcaaggttgcagtgagctatgaacatgccactgcactccagcctgggtgacatagggagacactgtctcttaaaaaaaaaaaaaaattctgagctaggtgcggtggctcatgcctgttatcccagcactttgggaggctgaggcaggtggattgcttgagctcaggagttggagaccagcgtgggcaacatggtgaaactccgtctctacaaaaaacccacaaaaattagcagggcgtggtggtgctcacctatagtcccagttactaggatgctgaggtgggaggatcgcttgaacccagcgagcagaggttacagtgagccatgattgcaccactcactgcattccagcctgggtgacagtaagactatgtctaaaaaaaaaaaaaaaaaaaattaattctggttgaatacactgtctgctttactagttttaaatatttctctttccttatccataattttattgcctttcagattatatctgggtgttggcacccagccactattctgccaatgaagtacatcctggtcacgggtggggtcatctcaggcattggtaaagggatcattgccagcagcattggaacgattctaaaatcatgtggactccgagttactgccataaaaatcgacccctatattaacatcgatgctggcactttttcaccttatgaacacggtacgaaagtgaaccacttcccccttatagcactaggctcaactgcattctttcttccattttgggtaatttctttaggatgtagttccagatttagagtgactagatcgtatgctatgaatatgtgaattttctcatggtcattgatacattgttcatacctctgatgacattccaaattaatcatcccttttggaaacattgtatcttttgcactacagattctgttttatttttaacataaaggtagtgtgtttctcttaacatttcccactgcctggagtaactattattaatggtgacattttgatgtatgagtatatttgatttatttttaaaatggcattagcccttacatgctatttttaaaaaactttttataaggcccagtgcggtggctcatgcctgtaatcccagcactttgggaggccgaggcaggtggatcacgaggtcagaagatcgagaccatcctggctaacacagtgaaaccctgtctctactaaaaatacaaaacattagctgggcgtggtggcacgtgtctgtagtcccatctactcaggaggctgagacaggagaatcacttgaacctggcaggcggaggttgcagtgagccaagatcgagccattgcactccagcctgggcgacagagcgagactctgtctcaaaacaaacaaacaaacaaacaaacaaaaacaacaaaaaaccaacccccaaaaaaacctttttatatacaagcaaaaaagtgcataaatcataagtgtacagttggatgaattttcattaaatgaacacactgtgtaaccagcccctgatcaagaaacagaaatgttcatgtcctgccgggcgtggtggctcacgcctgtaatcctagcactttgggaggctgaggcgggcggatcacgaggtcaggagatcgagaccgtcctggctaacacggtgaaaccccgtctctactaaaaatacaaaaattagccgggcgcggtggcgagcgcctgtagtcccagctactcgggaggctaaggtgggagaatggcgtgaacccaggaggcgaacttgcagtgagccgagattgcgccactgcactccagcctgggtgacagagtgagactccatctcaaaaaaaaaaaaaatgtttgtgtcccttgttgctatcctgtcttcctgtttttgttttttgagacagggtctcactctatcgcccaggctggagtgcagtggccaagatctcggctcaatgcaacctccacctcctgtgctcaagtgatcctcctgcttcagtcccctgggtagctgggattacaggtgtgcaccaccacacctggctaatttatgtaatttttttatagagctgggatttcgccatgttacttaggctggtctcgacctcctgggctcaagcaatcctcctacctcggcctcccaaagtggtggtattacaggcatgagccactgcaacaggcatgagccactgcaccaggccttgaatatcgtgttttaaactttactaacctgagaataaaacaaacaaaaagagggtatcttattgttttaatttagagttctttgattttgattttgtttgtgaatgacttattcaagtctgtggtagattgtatttttgcttcaaaatgttacccaccatccctctgtggagtacatttccctgccctttgaccttggagtttggccacgtaggatagttaacttgtcctggtttgtttggaatgttcctgattttaaaacagaaagtcctgtgtcctgggagccctcttagtcctgggcaaaccaagcaggttggtcactctatttggccatgtgatttattttgtcctatgggatgttagggaatattaacatatgccttgttgaagcagaaaatgtcaaatgcatctgtgtggtttggctcagtctgtcttgtgcttctgccctctaccatgagaacagcctggttttcagagatttctcgttcagtctgggtcctggaatgagaagacacaaagaatagactcacaagtgactcatagcccccatgtaacatgagggagaaataaataaatgttttgtaagttgcagagattttggggttgtttgttgtgtggcaccattgactaatgccatgtgttacaccaaattttctttggatttttttttaatgattttttttttctttttttgagacagagtctcactctgtcgcccaggctggagtgcagtggtgtgacctcggctcactgcaacctccgcctcccaggttcaagcgattctcctacccagcctggcaaacatggcgaaactctgtctctatttaaaaaaataataggccgggcacggtggctcacgcctgtaatcgcagcattttgggaggctgaagcaggtggatcacgaggtcaggagatggagaccatcctggccaacatggtaaaaacctgtctgtactaaaaatacaaaaaaattagctgggtgtggtggtgcacacctgtaatcccagctactcaggaggctgaggcaggagaattgcttgaaccagggagtcagaggttgcagtgagccgagatcgcaccactgcactccagcctggcgatagagtgagaccctgtctcaaaataataataataataataatggtaatacaaagattagccaggcgtggtagtacatgtctgtaatcccagctacttgggaagctgagacatgagaattgcttggatccaggaggcggaggttgcagtgagctgagatcacgccactgcactccagcctggttgacagcgaaactctgtctcaaaaaaaaacattgaaaaaaaaaattgaaaaaaaaagtattgtgatatcaatttgcttttttccttaaaattaattttctagaccacagttatgtaccttagaatggataaataaattaggatataaaaggcttctgattaaatttgtaagttaatcaaccttttttcctgtggacatctaacagtaggaataaatgatagttcccttaataggggaaaggttcaattcttacaaggtggctttagaaacatacgactctcagtccatgccctgaagtgacaatagagatctacagacgtgtctagtagttaaagttggtgctcctcgtgtgacgaagtctgcacctgtcttttatgacagtgcattgtgcacgtagcttatggcacacacaggctttttccctcactttcaccaagttgccttatgggttagctgtggccttgctttgtcatctactgtctaattatggctttaatcaagatgagaatcaagtaaaagtttcttatcgcagttccagagtccaggatactgatgctttgaagtaaaatgctgtttgtttttaaaatttctgttttcatgtcttttttatgtggcatatgttgagtttggaaaagctaaatcttgaagacagaatttcagtagattaaaaaaaaaccacaatagaatattataaatagaattttctgatgcattttcttggatataattgaattgttaatatctccaccaaaaaggagatggtgatagaatatggcttacaaatacatcttttaccagctttttaacaaaaatatgtccatctttgaaaaatctactggaagcaaagttttgatttttccattgcctttttaatcctaggtgaagtcttcgtcttaaatgatggtggagaagttgatttagaccttggaaattatgaaagatttttggatattaatctttataaagacaacaatatcaccacggggaagatatatcagcatgtgatcaataaagagaggcgtggtgattacctggggaaaacagtgcaaggtattatattccacagacattatggagccctgtgtgctgaatatctttgtactgctcaaaagtagaactgaaggccgggcacggtggctcaggcctgtaatcccagcactttgggaggctgaggccagtggatcacctgaggtcaggagttcgagaccagcctgaccaacatggtgaaaccccatctctactaaaaatacaaaaattagccaggcatggtggcgcatgcctgtaatcccagctattcgggaggctgaggcaggagaattgctcgaacccaggaggcagagattgcagtgagccgagatcgtgccactgcactccagcctgggcgacagagtgagactccatcttaaaaaaaaaaaacaaaacaaagccaaaaaaaccaagtagaactgaaaatgtcacagtccctgcgctctacaagttctaattcttttaaaattgttgcgtttttttcttttcattttccaaaaatatgtcagggtaacttgccaggtgactttcaggtgattggggaggcctaaagcacattcttttctcatgagcatggaataaacttttgtattaatacttctttctacagttgtccctcacattactgatgctgtccaggagtgggttatgaatcaagccaaggtgccggtggatggtaataaggaagagccccaaatatgcgttattgaggcaagcatagaactttctttataaaattatatcctgctgggtctttgagcatctgatcttcatttatttgacaaatacttacacacgccctcctgagtgctggacactgggctaggaggtggggtcacagcaagaaacaacatagatggcttctgtctttgtggtcacaagtgagtgggcaagattggcattagacagacaatcacacctactcctgggtggacgtgcagtgatctgcttgtggagactgatcagctgctgataaagtcaatgtgagggcctcttctgtgccggggcctgggatgggcacagtctctgaccttggggagcttgcagacaaccctgtctacacacaacagactgcattctagtgcatactatttgaaaagtatttccgaagtgctttggaagtgtaaagagacactgggttagggaagtcagatggtagcggtgataagtgattagtatcagctgtttaaagaaagaagctagtggctgcgcgaggtggctcatgcctgcaattccggcattttcagatgccagggtgggaggattgcttgagtccatgagtttgagacagcctgggcaacatggcgaaaacccgtctctacagagactacaaagattagctaggcatgttggtacgcacctgtagtcccagctacttgagaaggtgagatgggaggatcttttgagcccgggaggttgaggctgcagagagcagtgattgcaccagcacttcagcctgggtgatggagccagaccctgtcttaatttaaaaaaaaaaaaaaaaaaaaaaaaaagtcgtatttgaacttgccacttgtttacttccttcaccttgttcccttcctctccacgtgcagaatgacaataacatccatatcctcctcctctaaatgtcagttggcttaattgccgggcgaaagagcagaataatgaccaatttggttcttagagtcaggctgcctcagtttgtatttctgcagtgacccctgagccacgtatagctcagtgattaagagtctggaggcaaactgtctgggtttgtagcctagcaaggtcacttatggggaggagggggtgaccttgggcaagtttgctcaacctctctgtgcctctttaactcatttaactcatttgtaactcattgttttgaagattaaataagtctctacacttagtgcttagaatggtgtcacagatatagtaagtgcttaaaaattattagctattattaagatgcctgtatgacttttggaaaattctcacagtttcaacgtcctcatttgtaataatgtaataatataatattataataataagataataacaggattggggattaaatgcaatgtatcagagcactttgcaatgtctggcatttaggaagtgctcagtgaacataagttagctattattattgtcatcaatgtaagtgttagcagatatcatgatatgtagaagatccattttgttaatagtagaactgataaagttactggctatttattttttatagatagggtctcgctatgttgcctcgggctggagtgcagtagctatccacaggtgcgatcaaagcccactgcagcctcaaacttctgggctcaaccaatcatcttgcctcagcctcccaagtagctgggactacagtgtaccaccactatgcctggcaaatttttaattttatttcttattctacccttgaattgacttgtcttcacaatgattaatttagcacttaatatgtactagccctgatgatagctgctaaggatgtgaggttgagtgtgatctgactcctgctctccaggagctcattggctggattttaaatttcatggaaacagggaaactgacaaacagaaccccttctccgttataaccctgatgtttatatttgcttattggatactagtggtcaaccatcctctttggttgattgtaagttgtgttcaacagttgtgtctgtgcaccatttaagcttttgaagaaggactgccaaagctgatttttagttttaatcatagaggagctgttgaaatgtcttcaaagccatttttatgagtgagacctcaacttctcataccagtggagctgacaggttttatttatattagtacgagttatcttggcatgaacctgaaataatttatgcttgtcttaaaggaataacagttttctttcttcttgtttattttccaaaaaagaagactcagccaagtgtggtggtgcaggtctgtagtcccagctacttgggaggctgaggcaggaggatcatttatacccaggagtttgaggccgcagtgagccatgatctcactactgcactccagcctgggtggcagagcgagactctgtctttaaaaaaaatttaaaaagggccgggtgtggtggctcacgcctgtaatcccagcactttgggaggctgaggcgggtggatcacgaggtcaggagatcgaggccatcctgtctaacacggtgaaaccccgtctctactaaaaatacaaaaaattagccgggcgtggtggtgggcgcctatagtcccagctactcaggaggctgaggcaggagaatggcgtgcacccaggaggcggagcttgcagtgagccgacatcgcgccattgcactccagcctgggcaacagagcgagactccatctcaaaaataaataaataaataaataaaaataaaaaaagaaaaagaaaaaagactttcattaaagacaaaggcaaaaacaactttgcacatctcataaatttgctgctgcttccatttcagcataaagtattgttataggtgatattttcccttttatctggggcaacagttaacttcaaactattccagtagtaatattgaaggtttctgaacacgataatgtgggtgacctagaggtatggtaatgggaacttctgaattagcagggagactgtagtaccgctgctgaccacgtgagggcagaagctgataatgtttgaagttggcctccttttggcattcactattattgaccccccagagaatccccatcaaaacacaagatggaagcacacggtttagtttaagtgcagacctctggttttccttagaaaaaataaatgattttcaaaaattagattttggtgccttgtatttagtgggtacttacactcacttcacccctgccaagttcctgattgcatgtgatgttttcatttcgttgagttgttgttgttgttgttgttgttttttaaagagacagtgtcttactctgttccctaggctggagtgcagtggtatgatcatgactcactgcagcctggacttctccaggctcaagcgatcctcccacctcagcctcctgagtggctgggaccataggcgccgtgccgccatgcccagctaattttttatgtttttgtggaggcaaggtctcactttgttgcccatgctggtctcaaactcctgtgctcaagtgatacacctgcctcccaaagtgttgggattacaggtgtgagccactgcacccagccctggctttggttctgctgtaattttggtaacaggtactagaacactgttccttagggcttatattgaatttcaggacctttctgtcctggcccgactactaaactaaacctccagtgctgcatgcagggtactgggctcatgccctcatggggcttacagtctagtggggtagagagccaggaaacaaagacggaaatgaaatagaggcaacttgtgctgaattcctaggatgggtacagtgctgtgacaagggctagtgggatataggctgctttaggtggggggtcagagtctgccctccaaggagggtcagagtccgccctccaaggaggatgcatctctcttggactggaggataaagaggttgctgtagatgaagaaggagggtaggagggcttaaggagcaggaaggaagagcatggagtacccaagaggccagcggggaggggaccagatggcattggagactcagtgcaagggccaggtcctgagagccttttgttggctgcattaaggagatttgatgctagttttttgtttttgtttttgttttgagatggagtctcgctctgtcgcccaggctggagtgcaacggtgtgatctcgactcactgcaacctctgcctcctgggttcaagcgattctcctgcctcagcctcccgagtagctgggactacaggtgtgccccaccacgtccagctaatttttgtatttttagtagagacagggtttcaccatgttggccaggatggtcccgatctcctgacctgtgatccgcccgcctcggcctcccaaagtgctgggattacaagcatgagccactgcgcctggccttattgttagttttaatgaagcaatgggctactgaagagtatacacgtggagaaatcttttttgaagttttattttttatttttatattttttcagagaaagggtctcgctctgtcatctaggctggaatgcagtgggatgatcatgactcactgcagccttgacctcctgggctcaagtgatcctcctgccttggcctcccaaagcgctgggatcataggtgtgagccgccatacccagccacaatttagtgattttgaacgtatttataaacctctgtgtaaccatcaaactttagttctcatgctcggtttattaagaactctttttattagcttgtgtactgtgggagatgtgtggtcatttgtgtctttttttgtttgttttccattcccagctgggaggcaccattggagacatcgaaggaatgccgtttgtggaggcgtttagacaattccagtttaaggcgaaaagagagaatttctgtaatatccacgttagccttgtcccacaggtgggctttccagataagtatgtggacagcaactttgataagttttcctatgatattctatgtgtcctgcatttgaaagtggggcaccattaatcatccataggagctagtgtccagtgtgctgacgggaccccattttttttcagctcagtgctaccggagaacaaaaaaccaaacccacccaaaacagcgtccgcgcactgaggggtttaggcctgtctccagatctggtgagttgaggacagtgggtaagtctatcctgaaggtctctgggagcaggaccttcacttcttttttttttttttttttaatttgagacggagtcttgctctgtcacccaggctggagtgcagtggtgcagtcttggctcattgcaacctccgcctcctgggttcaagcgattctcctgtctcagcctccagagtatctggactacaggcacatgccaccacacctggataattttggtatttttagtagagacagagttttgtcatgttggctaggctggtcttgaattcctgacctcaggtgatccgcccgcctcagcctcccaaagtgcttgggattacagccaagagccaccatgcctggctgcccttcacttctttatctttatcatcatctaagtcctttctcattctcaaacggctcctgtgacaatgaggtttttctatctgggagccggaaaaggcttattcccttagcctcaagtgttgcttcaatctgttcttccctaggctctcatttgatgggccacattgatagttgggcaagtgtgatgtcctgtcatttatatgattcctggattctttagaatgaaggtgaaaccttgggattttcctgtgaccctgctatcaatgataaccctgtgatgggttatcactgctctttttttctttttgagacggggtctggctctgttgcccaggctggagtacagtggtgtgatcttggctcactgcaacctctgcctcctgggctgaagtgattctcccacctcagcctcttgagtagctgatactagaggtgcacgctaccacagcgcactaatttttgtgtggtgtgtgtgtgtgtgtgtgtgtgtgtttgtagagacagggttttgctatgttactgaggctggtctcgaactcctgggttcaaccaatcctcctgccttggcctcctaaagtgctgggattgcaccacgcccagtccgctgctcttatttttagtctaaacagtgatgtgtccttatagcaggtgatccagtcatcaccagtagtctctgtcagaggttgacaaataacagcccacaacttgcttgcctgtttttgtaagtaaagttttattggcatgcagtcacacccattcatttacatattgtctgtagctgctttcacactgcacctcaattgaggatcaggacagtgactgtgtcacctgcaaacctaaaatatttcccatctggcccttttgagaaaaagtttgttaaccccgatctagctcttttcttgtagttaatgaagcaacacttgtgagcctggactctgttcaccagagacgtctcgatgtttcgagttcttactgatacacttatgctgaatttgattatacttatattagtgctcagaccaatttctaatagtccagtggaatgtccaaagtgaacaagtacatacttggccaagtttcttgtaaaaagaaatgaatgtggcatcctgctgaaagtgaatcctgtttgctgaagcataactggctttgacagattgtctgccgaagttcaacgcccattgagatggccgtgaaggagaagatttctatgttttgtcacgtgaaccctgaacaggttggtgctgctctttagattttattgtctggcaggcacttctgctgatgccagtgttttgtacctcttcaatgatcatattacttttcacggcatttatgcaagcactggggaaccctgatccaaccatgattccctagcccttaagtgagataggatgcatgtttctttgcatgatcactcaacttatgtcacaaaaccagggtgggctttcttttcttgagacagagtgtcactctgtcacccaggctggagtgcagtggcatgatctcagctcaccgcaacctctgcctcctgggttcaagcaattctcttattttagcctcctgagcagctgagattataggcatgcgccaccacgcctggctaatttttttgtatttttagtagagatggggttttgccatgttggccaggctggtctcgaactcctgacctcagatgatccgcccgcctcagcctcccatagtgctgggattacaggcgtgagccatcgtgcccagtaccagggtgggtgtttaactcacagtcaaacctctagagagagaaccacatgaagcctacttatcatctctttatcttgtgtttccttctggaacacttactgctttcactcatttctcctctctacctgtggcagcttaagtcaccccaaacacacgagcacgttgacattcgcactagctcttctgactccatcagtgggctcagttgacttcattggtacagaaactgtactgtgatttgggcttaggttctctgctctgtagggctttccaccttggtattctgataattcgcttttcttttttctttccttctctcatctctgtctcttgattccaataaggcttggttataagggattggagttacctatagtttaaagagagtgatataaatggtgctcaggaaaagggtgaggtttggcagaaatcttttcttcagattataactctgggttctctgaagtctaaaaatgatcaaattgaattttggcatcttggaaaatagtctgatggagagccccctgcctgatgcctcagagtcattgccgaagtctgaactactttgaaaaatgtgatggcagattgaagggacacttctgcatctgtatgttgatatgttgtcatgccattttgtttgcgtccaatctttttttttttttgagacagagtttcactattgtcacccaggctggaatgcagtggtgcactcttggctcagtgcaacctctgcctcctgggttcaagcgattctcctgcctcagcctcctgagtagctgggattataggtgtgtgtcaccatgcctggctaatttttgtatttttagtagagatggggtttcaccatgttggccaggctggtcttgaactcctgacctcagatgatccgcctgcctcagcctccaaaagtgctggaattacaggcgtgagccaccacacctgacctgtccaatcgttttgtgtacacttcttttttttttttgagatacagtcttgctctgtcacccaggctggtatgcaatggtgcgatctcgactcactgcaacctccgcctcctgggttccagcgattctcctgcgtcagcctcttgagttgctgggattataggcacatgtcaccatgcccagctaatttttgcatttttaatacaggtggggtttcaccatgttggtcaggctggtctcgaactcctgacatcaggtgatctgcccgcctcggcctcccatagtgctgggattagttttctaattaaatgaagctaaccttgtgcaaattctgatgctagctttggttgctgggtttttgtgtgtgcgtgtgtgtgtgttatatcagtgtaaataaactgccagtctctgctgaattttgtttcattcttgtggtggcatatttgaatagatccatctaagtatggtgatttctcatcgccacttaggtcatatgtatccatgatgtttcttccacataccgagttcctgtgcttttagaggaacaaagcattgtgaaatattttaaggagagattgcacctgcccatcggtgattctgcaagtaatttgctttttaagtggagaaatatggctgacaggtaagcgaaaggaattacttgtataatctttaataatttttgagtttgggggtagaactaagacctacttgaaagggtaagcgtgtgtatttggcattttgcgtgtgcacattttggtctggatatgtctaaagatggagcatactgttgcggtgctttgctgtattatttgaagatttctggagcctttgattttgttatacataaaccaaagtgaattaaaggaattcgaattctggaaggaatgtttttttagctctggaaggattctgatttatttgatttatttgctagttcattttttagtttctgaatatttaaaatttttttttgtttgttttcttttttcttttttgagagtcttgctctgtcacccaggcgggagtgcagtggcacgatctcggctcactgcaacctccacctcctgggctcaagtcatcctcccacttcagcctcctgagtagctgagactagaggcacacaccaccacacccggctaatatatatttttttttttttgtagagacgggatttttctatgttacccacactggtcttgaactcctgggctcaagtgatctgcccaccttggcctcccaaagtgctgggattataggcatgagccaccatgcctggccttaaacagttttaaacttcacaggttttttgttttgttttgttttgcttgtttttaagatttggctaacttttcctaaagaaaatcattttggatgggaacttttggctatgctagttttgtttcatcctgcattcattaactgttcagcataattattaaaactcctgatggattctaactttcagacaagtatattaatttaagcaaagtttctctattttgaagttatatgaaaattaagctgtgtgcagtggcacttacctgtagtctcagctacttggaaggctgaggtgagaggatcacttgagcccaggagttggaggccagcctgagcaacatagcgagaccctgtatcttaaaaaaaaaaaaaaagggaaattaagtccctgtcacttgttttctttttttttgagatggagtgtcactgtgtcgcccaggctggagtgcagtggtgcgatcttggctcactacaacctctgcctcctgggttcacgccattctcctgcctcagcctcctgagtagctgggattacaggcgcccgccaccatgcccagctaattttttgtgtttttagtagagacgggggtttcaccatgtttgccaggctggtctcgaacttctgacctcaggcgattcgcctgtctaggcctcccaaagtgctggggttacaggtgtgagccaccgcgcccggccctgttttcttttactaaatgtagttgagatgggacttcttgggcagcttaggtgagcgccagtaggtgcagctgttacgtatgtaggttctggactcaaatcctggcctcttctcttaccagctgtgtgagtttgggtgattacttaacctatctaggctttttttcccttctgtatataataaggggataccagtgcctacctagtggcaattatgagaggaaaccttaaagacttaacattgagtcacgtactataataagtatcggttgctgatgttggtaaccataattaaaatgatggtgacaaaattactgacccttggtagatgactaatcagattgaggctctcttgctctttcatttacaattttaaaaaatgctttagattttctggggcaagtggaatcaggaaggaagagcagtttctgagcttagattctctaaaacccttgctctctagagtgcttaaagtgccagtcatttcacaggaattttctaagtagcttggggctgatacactttaagcactagaagttttaatattttaactctttttattggaaatagctctaaattatactctatgcgtttatgctttttttctttttcttttctttcttttttttttttttttttttgacacagggtgttgctctgttgcccaggctggagtgcagtggtgcaatctcagctcactgcagcctcgacctcctgggctcaagcgatcctcctgcctcagcgtccccagtagctgggaccacaggtgcgctacaccacggccaactaatttttgtatttttagtagagacggggttttgccatcttgctcaagtgatcttcctgcctcggcctcccaaagtgttgggattacaggaatgagccatatgcctggcgcttctgtgctttttaaagccacatgtttggtctttgtattagcttcctgggggctgccataacaatgaccactaactgggcagcttaaaaaaacacaacaggaatttattctctcacagtcctggaggtcagaagtgcaaaatcaatgcatccacagggttggttccttctagaggctctgcaggagattctctgccacaccccttctcctggcttctggtggctgccagcaatcagtggtgttccttggcttgtggccacatcactccaatcttgtcctccatcttttatttccttatttatttttttttttttgagatggagtctcactctgtcacccaggctggagtgcagtggtgcaaccagggcttaatgcaaccttgaacttctgggctcaagtgatcctcctgcctcagcctcccaggtagctgggactacaggtgcatgccaccatgcttggctaatttttgtgttttttatagagacagggtttcaccatgttgcccagcctggtctcaaactcctgagctcaagcaatccacctggtttagcctcctaacgtgttgggattaaaggcgtgagccaccatgcccagcctttggcctccaggcctccatcttcacatcaccttctcacttgtgtcttcttcccttctcttcttttgtaaggatgcttgtcattggatgtaaggcaggccctaatccaggatgatctcagctggagagccttacttatgtctgcaaagaccctttttccaaacaaggtcacattcacaggttttggggacaaatttctttgggggggggccaccattcaactcactacagcctttttatttttaatttttatgggtacatagtaggtgtatatatttgtagggtacatgagatatttggtacaggcatataatgcattataatcacatcagggtaaatggagtatccatcacctcaagcctttatcctttctttgcaatacaaacaatccaagtatactcttttatttatttaagaatgcacaataaattgttgacaattttcaagcaaggagatattgtgcatgggtgcctctgcagcactgggcctccctctgcatcacattggtggtgacattgttaattgatgcgaagtgtccattctttagctttggtcctctcagtatagcctgtagagaggtgcaaggagccaaacggaggccaaaggaacagcctctatcatggaggcccagtgctgctcagaggccaggggtccctgattaaacagggacagcttgcctgggacccgaagtcaaggtgggcacaattctccacctcctcctattcattgtcttttttttttttttttttttttttggagacagagtctcgctgtgtcgcccaggctggagtgcagtggtgcgatctcagctcactgcaagctctgcctcctgggttcatgccattctcctgcctcagcctcccgagtagctgggactacaggcgcccaccaccacgcccggctaatttttttttttttgtatttttttagtagagatggggtttcaccatgttagccaggacgatcttgatctcctgacatcgtaatccgcccacctcggcctcccaaactgctgggattacaggcatgagccaccacacccagccctcttcatctctcttgagacccgactcttgggggtggccctgcaaagaggactcccctccccctcccacagcagcttgaagtagtatcacatgcttgcctcacattcggtgatggctgatggctgagtggggcacatgagggagaccttggttgctctcggaagtacaggtccaagggggaatgagagctccctggtaggtgtgacccagtggactcacctgtaccacctgctgcccagtgactcctcccctgggaagaccagctgtgagtgagccgtaggagtaacctgtgatactgaccccagtgctgcttccttccgggggcagagctgatgttgtctcttctgtctatggaggagggagaagggggtgaagccaaatctgctgttctcaaatgcggctctgcctgcctgcctctgacatcatctctactacttggtgtgctgtcatcctgctttctgttacccgcatcctcttttttttttggagaagaagtctggctctgtcgcccaggctggagtgcagtggcatgatctcggttcactgcaacccctgcctcctggattcaagtgattctccttcctcagtctcctgagtagctggaactacaggcgtgcaccaccatgccagcctaatttttgtatttttagtagagacagggtttcaccgtgttggccaggctggtctggaactcctgatctcaagtgatctgccggccttggcctcccaaagtgttgggattacaggcatgagtcaccacgcccggcccgttacctgcatactttatggagaggtggtgtgagatacagacagctgtgaaacctccagagcaacataaaataaagtagtgagttcaagggttagcagcttgaactattttagtcaccttttagtgaccttttatcagctattttagtcatctttctagaaagttaccttccctgtcagttttgacttcttagcttcttgtgcattattcccacacatagcctgtttgtgatctagtttctcttgtactctttacagatatgtgttctttttgtttttgtttttttttttttttttttggagacagagtctcgctctgtggcctaggctggagtgcagtggtgcgatctcggctcactgcaacctctgcctcccgggttcaagtgattctcctgcctcagcctcctgagtagctgggattacaggtgcgtaccaccacgcccagctaatttttgtatttttagtagagacgaggtttcaccatgttggccaggatggtctcgaactcctgacctcaggtgatccacctgccttggcctctcagagtgctgggattacaggtgtgggccaccgtgcccggccactctttgcagatgttgatattcaagagagatattcgtcatcatggtaacatttttctaaggtgtttggggaagggtttgcttcaaagccctaaaacaccttcagccccaagatgacatttccacgtacctaataccaaaccagatatttttcatgttctttgaacagatttcctgacaaaagcaacactaaaaattgtgtctctaatggtaaaatgtgatcgagtgtcttctgtagaatggaatttttctcataaaaatgatctaaatggctagtaatattttaaatcgttctctcagcaccattcttcaggcatgccatgaataaccagacttttgtgggtcagctgggaatgtaaccattttaaatgtagacactttgaatgcattttcttacacaatgtcaccttacaaagttaatattggaatgtttcctactgacacgcagaatgcattttttttatacaatgtcaccttattaaccaatgtaagaatagctcatgtttatgagattgggatagcttttcaatttttacttttaatgcttttaactttttctctgatatacttgaatttttatctgtatctgcttgtgtaaaacaacgttgggatttctgtttttgttttatgagacagtgtctcactgtgtcgcccaggctggagtgcagtggtgtgatcatagctcactgcagccttggtctcctgggctcaagtgatcctccaacctcagcctcctgagtagctgggattgtaggcatgccccaccacgcctggctaatttttgtatttttttgtagagacggggtctaactatgttgcccagtctggtctcaaactcctgggcttcagtgattctctcgcctcagcctcctgagtagctaggactacagctgctcccgaggatttaaaaagtgccttggagtaagagcagcagctgccattgttctgtttgtgatgttctgttatgtgcatataacctttgagtttgttttctttcccaggtatgaaaggttacagaaaatatgctccatagccctggttggcaaatacaccaagctcagagactgctacgcctctgtgttcaaagccctggaacactcagccctggccatcaaccacaagttgaatctgatggtgagtcctggcctggtcttttggctatctcagtaattcatgccaatagcacatgttccagaggggcaagttttgttaaagggtccctgagatcacctgcaggacttacgattcaccagaagaactcacaggactcatcatatagttatactcatagctaagatttattatagccagacaatgcaaagcaaaatcagccaaggaaaagtcgtgcagggtgaagtctaggagtaaccaggcgcaagcttctaagtgctctcccctggtagagtccagtgagttgtgataatacatgcaaactgccatttactaaggaagctcattgaagacttgaagcccaaggtttttactgggggctggtcacgtaggcaccctcttcttagcacttcccaaaatgccagcctcccagaaggaaagcatgcagcagaaaccatgttgtctgtacagacactttcagcacagtgagcttctcctatcagttcttggaatgatgggaaccctcccaaaatcagagtttccagaagccagtcaagtctcaatcttgtagcaggcctttccaagggcagcagccaggcttgctgtgtaaacggttttcttttttccttttttgagacacagtctccctctgccgcccaggttggtgtgcagtggcatgatctcggcccaccgcaacctctgtcttcaccgttccagcaattcttgtgcctcagcctcctgagtatctgggattacagactcccgccaccatgcccagctaatttttgtatttttaatagagacggggtttcaccacgttggccaggctggtctcgaactcctgatctcaggtgatctgcccgtcttggcctctcaaagtgctgggattactggcatgagccactgtgcctggcctgtgtaagctgttttctacatgtaggtttaaggcacatttctgaaagtaggctttgcacattcagatgaatgagcatgcttgtcatgctcgtttaagtacgtcgtaattgcctaacaggaaaataataggacattttttccctttagcattggaatggaatctagattttttaaaatactatattcccctctctaacatggaggaatgatagctagcaaacagtgattatttgttttggaaactcagtattgtggaataacagaggcgtagttatcttatatagcttgagtatattcttccatataagaacggaagtagtacatgtttagagtaaaacatttaaacaaagcataagccaggcgaagtagttcacgcctgtaatcccagccctttgggaggctgagccaggtgggttgcttgagctcaggagttgaagaccagcctgggcaacaatgggagacctcatctctataaaaaaaacttaaaaagttagccgggtgtggtggcatgcgcctgtagtctcagctaattgggaggctgaggcaggaagatcacttgagcccaggagtttgatactgcggtgagctataattgcgccactgcactccagcctgggtgacagattgagaccctgtctccaaaaaacaaaacaaaacaaaataaagcataaatctaaaatgcagaaagcagattcctcctccctgaaatcccacttgttaccagttggatacgtatatttatatatctatctcacatttatatttaatgatattcagtatgagtatatcattgtttaagcaagtcttatcatcttgacttaaatggcaaaaactttgtataatgagtaaaaagatccatttatatgttaaagaaatttaatggcttccactttgacactagcttaggagaactagctgctgtttctctctcctctttttagcctccttctttcctaatcactttttaaaaattttattttattattttttaattaattaattagttaattactttttagatggagttttgctcttgttgcccaggctggagtacagtggtgccatctcagctcactgcaacctctgccttctgggttcaagtgattctcctgccttagccacccgaatagctgggattacaggcatgtgccaccacgcccagctaatttttgtatttttagtagagatggagtttcttcatgttggccaggctggtctcgaactcctgacctcaggtgatccacctgccttggcctcccaaagtgttgggattacaagcgtgagccatcgtgcctggcctattttttaatttttatagagacggggtctcgctatgttgcccaggctggtctcgaactgctcaaacaattcctcctgccttggcctcctaaagtgctaggattacaggcgtgagccaccatgaccagcccctaatcactttttacttttggctttctaaggaatagtttacttcccattcctcccactccttcaagtcgcccgccccattatgtaaaaaaaagaaaatggcaatggaaaaattgccatgacatatacattttataaagcctttagaaatttgtatcttaaagtttatttgaatagtcttttttttttcttttcttttctttttcttttttttttttttgagacagggtctcgccctttctcctagggtggagtgcagtggtgcgatcttggctcactgcaacctccacctccggggttcaagcaattcttgtgccttagcctcctgagtagctgggattacaggtgcccgccaccacacctaattttgttatttttagtagagacagggttttgtcatgttggccaggctggtcttaaactcctggccttaagtgatccacctgcctcggcctcccaaagtgctgggattatagacgtgagccactgtgcttggccaggagagtcatttttacagaagaaatactaaactaatatagatagagagggactgttatatacataagaattggtgcacatgatgcttcatctgataggattcattgacattagcttctcctaagtactgtttgaatcctggccttgtcatcttccttctaagattgggctgcatctgtctatctctcctggtttgctgcagctgcagcggcttccgggctggtttccagctgccagtcttccctgcctttgccacactctaccagagtgatcattgtaaaatctttctcggttctctctgttcctgtcgtccctttacttaagatctttcagtggtgtctcagtctgttcaggctgctgtaacaaagtaccatagaccaggtggcttacaaacaactgccatttctctctcacagttctggaggctggaagtccaagattagggtgccagcatgtggccgggttctggtgagggccctcttttgggtgcagaggaccaacctctggttatatccccatgtgcggaaggggtgagggaggtctatggggccttttttataggggcactaatcctattcctatgtgctctgccttcttgacctaatcatccctcaaagaccccacctacctcctaataccattcctttgggagttgggatttcaacataggaattttgggggaacacagacattcaaaccattgcaattggcttcaagtgtcaagtctgtgtcatggcttctcagcctcgtcccttgccttcctccaaccaatcaggtctgtcctctcgctgggtggggccttttttgagggtcccagagtggctaccactttctctctttttcctctgaggtttcatataagtggttcctttgctggagatttcttttttttttatttatttttatttttttattttttgagacggactctcactctgttgaccagacttgagtgcagtggcacaatctaagctcactgcaacctctgcctcctgggttcatgtgattcttctgcctcagcctcccgagtagctgagattacaggcacctgccaccatgcctggctaatttttatatttttagtagagacggggttttgccacgttggccaggctggtcttgaattcctaaccttagatgatctgcccacctcggcctcccaaagtgctgggattacaggcatgagccaatgcgcccggcctgctggagatttcatacccttctcccctcctctctttgtctcctgctgcctcccatcacacacgtgcttatcttgcttctgctctcctctcggctggcttcttgaacattacctccccagagctcttccttgacgtcaatccttcctgtctttcctccagtgttcagttctagtgacgtcctagttgctttttttttaaatttttttttgagacagtgtctcactctgtcactcaggctggaatgcagtgttacaatcagggatcattgcagcccggacctcccaggctcaaaggatcctcccacctcagcttcccaagtagctggggctacaggcacgtgccaccccacgcggttgaccccaagttacttctgcatcgttctcttctttgtctgtcatagccattatcacagtatagtgtggatgcccgtttatctggttttgtaatctttctgaaagattataagagccgcaaaacagagactgtttttctatccctagtgcccagtacagtgtttgcataataagtaattattgaataatgtgtcatagtattagatggctgcagtatttttgagtgtttatttttcttaaatactccttttatctgttggatgttttttagtacatagactccattgatctggagaagatcactgaaaccgaggaccctgtgaaatttcatgaagcttggcagaagctatgcaaagctgagtgagtaccagggcccacgcacaccagttaggataggaccattgtactttttctgtaatgattcagtttaccctaattgctaattttcatgcattttgaaaggtagtttggagtacttgtggtctttgcaggtgattgttccacgatcatactgcgttgatttgaaatgtgccatgttaatgctggtggcatgtgcatagaaatggttttatttggggaggatggggatactgtgggaaagtgtgttgattctcctgaaggatgcagagggaaagtgtgttgattctcctggaagatgcagagatgaatcttacatatgcaaagttaaagtacaagaatgacagctttttttttctctctctttttacaaagtgaaagcaagtttattaggaaagtaaaggaattaaagaatggctactccacaagcagagcagccctgagggctgctggttgccccttttatggttatttcttggttacatgctaaagaagggatgaattatacgtgcctcccccttttagaccttatagggtaacttcctgatgttgccatggcatttgtaaactgtcatggcactggtgggagtgtagcagtgaggatgaccagaggtcactctcattgccatcttggttttggtggcttttagctggcttctttactgcaacctgttttatcagcaaagtctttatgacctgtatcttttgctgacctcctatctcatcctgtgacttagaatgcctaactatctgggaatgcagtccagtaggtctcagccttattctacccagcccctattcaagatggagttgctgtggttcaatatttcccctctcccttttataggagaactcttaatactaagggttgcagagggacaaagctccatcttctgtaacttcttcgtgttgaataggggcaatgacattcctccctattagagtctcttgtatttggggtagagaagaggtcagtcagaaagcgtcagatggcgagggccattcataactctgagttccaacaaaaggtgatatctggaagattaataaatgtttagtttaagaaaacattgagtaagcttattctgcattcctacacaaagagtacaatagcaatatattccacaacagtaaagcaaaaaattatcccaagtaaactaaattagaaggctttccatgaactgggcaactgttggaaccaagctgatatgcagttgctagctgatttcaatacatgcccagaattagaatactgatcccaatttttacgttacccatccctcttgttttttttttttttttttccgagacagagtcttgctctgtctcccaggctggagtgcagtggtgcgatctcggctcactgcaacctccgcctcccaggttcaagcaattcttctgcctcagcctcccaagtagctaggattacaggcacgcgctaccatgcctggctgatttttgtattcttagtaaagacgggtttcaccatgttggccaggctggtcttgaactcttgacctcgttatccacccgccttggcctcccaaagtgctgggattacaggtgtgagccaccacgcccagccctgctcttgtttttttctgagctgcagtcacagatcactgattgtttcacaggaataagcagggtcagtctaaattgcagaaaaaaacttcaaaaacaaccaataagactagaattcataataataacagttagaccatagttcttgaaacataattttttctctctccagtttcccattttcactaaagacaaatcatggtaagaacaatttgctttattatacttggcctgattatttgtataaagtgcagcaagaataattatttttcaataggcttttaaaattggctttgacagaaccttattccataaggaatctcagataagaccttttttaaagctgagcccacccatgggtttgtaccctcaaatacctatgaattgggtaaattcctctctttttgaggtcccaagataacttgaggctcctggacctgtcagaaagtgacattctttagttaccacaggtcagaaaccctgtacagggactgtgtagacaaggtatgaggctagttttcccacggggcttgtattggctttacaattcaagttcgattctttacaggaaagcacaccattccagtcaaagccttggtaatataaccagtttctccctccaattgtgtcctgttgcaaaataaaaaagattcttattgcacttatgcaaacaactatattgccataagttaagaatactcacaaattccaaatttcccaattctggacaaatcaggtagagagaaacaaatatgctccaaattttgttcacaggagtatactttactcaattgttacaagctgtatatagctcaaaagaacagttttcttgactccgaaaaataaaacaaaaaggatcagcaacattttaagcaaagtaaaaaatattaattttttattagttcattccatggagctaactcctgttctacttgatagtcatgaacatttcagctctccatgagagtcctgaaagattttcctctattctgctgtcacaatctccaaagttatcagaaacttgcatttaagaacagctgttagagttctatagttgatttttaactaccttctaaagaggaccaaaacaatacaattgtctgtgggtgacaaaatgttttagggcagccactattaaagccacaattgactaggaatttgttacatctgtggcttacaacaattttgcataacaatgataattattaataacatacacgaattcatattagaattatagaagtttcttataattttggaacacatacaataacatatttatacaaatacagcccaaagaaagccaaacaccatttcatatttgacagtgcttttcgtataatttttataccaaatataccaaacttcaccattgcattagtgcattaaattcatgtcaaacccaatttttaataaaaccttatagataaatctatccaattttagtttgaccataaggtaagatttttacaaaccttctataatcctttacaagttttttttttttttttgagacacagtctcttgctctgtcaccgaggctggagtgcagtggtgtaatcttggctcactgcaacctccgcctcatgggtccaagcaattctcctgctccatcctcccgagtagctgggattacaggcacccgccatcatgcctgactaattttttttgcatttttgtagagatggggtttcaccatgttggccaggctggtctcgaactcctgacctcaagtgattcgcccacctcagcctcccaaagtgctgggattacaggcatgagccaccatgcctggctcctttagaagtttttgttaaagagcagatcagcactctaagagaaacctgttgtgcttttatttcaatgttcaatttatggaaaacctgaatacacctttaactttagccaatgtccacacgcataatttctttttttttttttttgagacggagtctcgccttgttgcccaggctggagtgcagtggcgcaatctctgctcactgcaagctctgcctcctgggttcatgtcattctcctgcctcagcctcccgagtagctgggactacaggcgcctgccaccacgcccggctaattttttgtatttttagtagagacggggtttcaccgtgttagccaggatggtctcgatctcctgacctcgtgatctgcccaccttggcctcccaaagtgctgggattacaggtgtgagccaccatgcccggcctgcgtaatttcttttataagattaatccttcacaaaccttctacaacttgctcaaactttcagctttatcttatctaacttaaaataatccgttagctggatgcggtggcttacgcctgtaatcccagcactttgggaggctgaggtgggtggatcacctgaagtcaggagttctagaccagcctgactaacatggtgaaaccccgtctctactaaaaatacaaaattagctaggtgtggtggtgcatacctgtaatcccagctacctgggaggctgaggcaggagaatcgtttgaacccacgaggtgaaggttgcagtgagccaagattgcaccattgcactccagcctgggcaacaagagtgaaacttcgtctgaagacaaaaacaaaacagcaaaaaacaatcctttaaccttttaatctaggcaaaaaaaaaaaaaatccacattttcatgccttcttataatcttttactaaaaacacatttcactttccttatgcaacttgcatgtaaaactgtttcttcagtagtctcaattacagattacactgttaactcttaggaacttttacttttggtgaaaaacctggttagtaagcaattttaattacgtactaggtatggagcctaggacactagataaggtctgaccttttccagcatagctagggggcatggctttcaacttgtccccaagccttacctagaatctaatgctccaaagtaggtaaattgaacaattttcaagagtcaaagcagtttatgaccttaaagcattgagaaaacctaatatctgacctgcctaatttagaccaaatgtctttattttcccaataatctttaaagctgtttttattacccaaagattactaaagttatgtgaactaaaagtcattacaatttttacttttcttacacaatacttgatttaagctttactatttttaaaccaattaaagctttttttttttaacatcacacacacaacacatataaatgcacagacagaaagaagatccagtagttgtaagcacccaaatatcaatcagaaaggcttatcccctaaactaggaattgaaccctgaacccaggtcaccattgtgatgatggagaccaagagaaagtactgccacatggttgcaaggtcaagctcccaaggacatgaaacaagatgagagggaacccttatctagtttttcttcagggacctacagcaaagtttgttattgaccagtttgctggggtggcttgaacagcaggcttacaggggtcctaggcccacattctatcctaagacccctcattatgacagaacaatacagaaagacacacaaagcacaccagattcactgtagcttaagagtagcctcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcatgaacccgggaggcggagcttgcagtgagccgagatcccgccactgcactccagcctgggcgacagagcgagactccgtctcaaaaaaaaaaaaaaaaaaaaaaagagtagcctcacaaatcctttttaccattaatcaaaactttacacaggagacagtgatttttaccattcattcaaccaatttgcacagagagagagagaggccagaagtctgactggtaagaaattcttacccttttgtcggtatgctaggcttctgggttccctttccttgagcagccctagtgacccggctggctgcaccacagccctgggggccaagctgtaacacaaaggaaaattatcttttcctgttctggccagagcaaaatatgtgtgacaaaacatagacattagccactctgcctagcacccaatatcttactggcaaggctcaaacttgcccctggttgggccccatcatcattaatccaacctctgaccaggagtttcaacttgtctctgggcaagatggtcgccttgagtaacagaaaagatacgaaaaggaaaggagataaagggagaaaagcattgcccgcagcattttggggaaggcaaagagctcagggaggccagagaaagacgcacccattgcagtgacactgaaaagttcaggtggccgcttgtcggtcgtgaagggatcttttccaggagtctcatcaactctcaagtttccccttttgaggaggaaaaagctccccatgtcccatggtcctgtgcatgcctagttctgtcacccatagctatcagcaaagagtgcaaggcagaataatccaaagagaatagcaattaacatcccatagtgccaaacctattcttagcagagagggactttactgagagaggcctctaaccccctaaaccttaggaaggactctaaccttcctaagttgtgcctccaacccaaggtcattcaagcatccttgccttttattgagaggagcctttaactctctctgttttaggagagactctaagttgggcctctaacccaatcccatcctttacctgggtatatgcaccccatttacccaaagtcagccaattggtgcacacagacgattttcctttgggtctggggtctcttcagtattgttctttccgtgtttcactagaaagatgttactggaggctgggcatggtggctcacgcctgtaatcccagcactttgggaggctgaggcggtcttattgcctgagctcaggagttcgaggccagcctgggtaacatggtgaaaccccatctctactaaaatacaaaacattagctgggcgtggtggcgtgtgcttgtaatcccagctactcgggaggctgaggcaggagaattgctggaacccgggaggtggaggttggagagggccgagatcgcgccactgcactccaggcagggtgacaagagcaagactctgtctcaaaaaaaaaaaaaaaaaaaaaaaaaagaaaaatgttactggaccccaccacgtactcagtattgtcccttctgtggtcgctagaaagatgttaccagaaacgggtcccaatccagaccccaagagagggttcttggatcttgctcaagaaagaattcagggtgagtccatagagtaaagtgaaagcaagtttattaggaaagtaaggacataaagaatagctgctccattgacagagcagccctttctctcttgatgatattttccacatgtcttagattttaggttttattttgtaagtaattgacagaactcttgggggcagcattgcatcatgaggttagcatgatcctcctgggttttctgttgaactgtgttgctgttgtgtttgcctaggtctgtgaagtcttctagccaagaaattttcatttgccactacttaattagcatttgaaatcttaggctgatttttccaatttaactctttctgatgatgtcagagatcttaacatttttataatagtgttttgaaagaaccttaacctattttcattcagtttcttttcccagtggcattcttaattgaattgggtttctcagttagtatgctctgatgccacaaagacttatcgtaaaatatatattgaggtcagttgtgagaaattgtcacaatttcttcataacattgggaagatttcagaaaaaaagttcagggtgtgaagtcatataattggttctgaaaatagagcttgagcatagtcactagtgattggaccaagcattgcacgaatggctgaatacactagtttaaaaaaaaaatggatagtcaagtttaccctcattttgtattgatttcagtggtattcttgtgcctggaggctttggaatcagaggaacattgggaaaactccaggcgatttcttgggcaaggacaaagaagattccttttctgggtaaaactcatgtttattgaccctaactatgagtttattagatttttgacacctaggaggggtaacactaaaggtttgttatcgtaaaggtgtgaactcggatttgaaagttcaggtgccaaatagtctgctatagggtcaacaaactatattctaaatttggcccacagcctgtttttatgaataaagctttattggaacacagccacaccaatttgtttacatattgtctatggctgcttttgtggtccaacgtcagagtttcagaccctacggcctagaagctttactatctgaaagaggctagaatctttactatgtgaccctttacagaaaacgtttctcatcctaggagaacttgctgctattccagctgggtagcagaggctgggagaaggctccatctgcaactgtgcttaccttctccaattcccacctcagtctccagagtagctgggactacaggtacacaccactgtgcctggctaatttttgtgtgtgtgtgtgtttttttttttttaagagatggagtcttgctatgttgcccagcctggcctcaaactcctgggctcaagcaatctgcccacttcagactcccaaagtgtggggattacaggcttgagcccccgtgcccggccgagttgagcctttttaatgcttttttttcaaattgcgaagtacggcttctgtaccagggaaaccagaggaaatgggaccttgatgcgggagaggcagccctgtagctggggactcaggcaggagggggagtgcagagaggctgtgtttcccactgtgcagtggatggctgggtgggtttatgagcccattggacaggcttttagtgccagcagaccatttatttccccccattacctgctctttgattagcttcttagactctctcctcttaggatccattttcaaaatagaagactggagtagttacctggataccttgttttcttttactggtctaagctcgttgggggccattgtttttttttttgaagtttctgtctaaatgtgggtaatgttcctcagattattttaatagtatggaatggtttgcaggtctttagctttccctctagcatagcatctctttatgtcccagccatatggaactttctgaaatccccctcaccgccacccccaccccccagcactcagctgtttcctgcttattgacttctgttctggcatccctgatatattgattgctcccttctttgtttcccctgtgtacatcttaagtatctatcggaggagcatctgggatgctctttggcatttgtttagtggagagaattggtgaactgcagtgaaggcggagctgggtctgggagcatccctgtggcaacaggcttgggcgacacaggtctgccttccttcatcaccgagcactctgttcaggcccatcgtgtctccttccctgctgcccaccatgctcaagcccactgtggagtctccaacccccaccccccactgctgcttttccttacagtgaaggctatggggctgcctgtgggttagcagcctgacgtcctgtaggcactcaacctctggccaagcctgtgtttatggctgtgaagtcaccatgagaaggagtgggaaatcttagcccaggaaactccctctgagttggggtgttagatgttctctgaaggaatcaggcactgcagcccactaagatgcctcaactcagggacaaatctagaaggtggcagatttgtctcatggactctgcctctttctttccttctttccttccttccttccttccttccttccttccttccttccttcctttccttccttccttccttctttctttctttctctctttctcccttccctcccttccctccccttccttttccttctccttccttccttctttcttccttcttccttccttccttccttccatccttccttcttcccttcttccttccttccctccttcctctctctctttttattttctttttttttgagacagagtctcgctctgtcgcccaggctggagtgcagtggcgcgatctctgctcactgtaagctctgcctcccaggttcacgccactcccctgcctcagcctcccgagtagctgggactacaggcacccaccaccatgcctggctaatttttttttgtatttttttttttttagtagagatggggtttcaccatgttagccaggatggtctcgatctcctgacctcgtgatccgcccaactcagcctcccaaagcgctgggattacaagtgtgagccaccgcacccagctcctccttcctctctttctctctttcttctctttctttccttccttctttctcacccagcctggagcacagtggtgtgatctcagctcactgcaacctctgcctcccgggctcaagtaattctcctgcctcagcctcccaagtagctgggactataggtgcatgccaccacacctggctaatttttgtatttttagtagaggctggtttcaccatgttggccaggctggtctcgaactcctgacctcaagtaatctgctcactttggctttccaaagtgctgagattgcaggcttgagccattgcgcccagttgaccctgcacttttctgacctcatgttccttctttgtcaactttgggacttaggcggcttcatgatagtctaagcccctgccctgctctctgtcagggattcttctgagaggacagcagggagcaaaacaggcagagtcttgctctctgggagtctgcattctagataggggagacaggcagccaacaaatgaacagaaaatgtgaacaaatacaaagtgagttcatttgctttgcatatgtgctttttaaaataggagtttgtcttgggatgcaactagcagtgatagagtttgcaagaaactgccttaacttgaaaggtaagttcgaggtttgctaatgaccatttatttaaaaaattttctctcttcaaatatttttcagcactattggtgaattactgaactcttttcttaatcttcagatgctgattccacagagtttaggccaaatgccccagttcctctggtaagtggcttgtttatctttctgggtccagtcattgtcacttgggtcctggctcttgcctaaattcataaggggctattggctgggcgccatggctcacccctgtaatcccagcactttgggaggtcaaggcgggcggatcacttgaggttaggagttcaagagtagcctggtcaacatggtgaaacccctgtctctactaaaaatacaaaaattagctggctgtggtggcagatgcgtgtaatatcagctactcgggaggctgaggcaggagaattgctggaacccgggaggtggaggttgcagtgagccaagatcatgccaccgcactccagcctcagtgacagagtgagactccttctcaaaaaaaaaaaaaggcgggggggggtctattattattttttctttacagcaccagaacattttaaattacattattcttatattaaattcctttgttcttgatagtccatcttctcagctatgccttaaagacagtcacaatcctggactgatttctctttgtcgcagctttcaagcttaatgtttaggaaaggattaaatcggctgtgacaacaatttataacatctactataaataaatgagctgtcctgtctccagactcatcaccagtctgcctattttccacactggtggtcatctgtctttctaaaacaaaagcgacagtgattctgctgccagtcctcatcttccatcagtttcttttcccttaaaatattcagtccaggattctgggctgggtcccaaagccactgtgctctgtcacctgctgctttgctgattcatcccatggcatcctgattcctcccaggctttgagtttttttcttttttgtgtttttttgaggcaagttctcactctgtcacacaggctggaatgcagtggcatgatcacggctcacggaagcctagacctcccggggtcaaacaatcttcccacctcattttttgattttttttgtagagacaaggtctcactatgttgcccaggctacatgctttgagttttacgtttggacaatctaaactagtttttcagatacagcctgaggttccctatacctgagatgtccacctgcctaaaatccctctccccctggaatctcaataaaagcattgaaaaatttaattaacaacaactcagttaccaacaacttcctattcatctgaggaaacctttcctgacctcttttctttacctgcctctgccttctgcctcatgctactgtgctcaccactaacagagcgagttctgcaagatgatggttggccttcagtcagcctgtttgccagccacccatgcacacccagtcgtgtccctgctgctgggcacctacttctaatggagctcgcgcctcacaatcgcgattggttttttaaacagctttattgagatacaattcatataccacaaaatttagccatttaaactgtataatccggccagatgcggtggctcacgcctgtaatcccaacactttgggaggcctaggcaggtcaatcacttgaggtcaggagttcgagactagactggccaacaagttgaaaccccatctctactaaaaatacaaaaaattagctgggcgtgctggtgcatgcttgtaatcccagctgctagggaggctgacacaggaaaattgcttgaacccaggaggcgttggttgcagtgagctgagatcgtgccattgcactccagcctgggcaacagagtgagactttgtctcaaaaaacaaacaaacaaaaaactgtataatccaatggtttttagcatattcacggatctgtgccactctcattacaagcaattttgggccattttcattactccaaaaagaaaccccacacgccttagctgacacccccaagcctcctatctccaccagccccaggcaaccattagtctaccttctgtcttcatagatttgcctgtttgaatcatttaatataaatggaatcatccaatatgtagccttttgtgactggttgcttttacttaggataatgttttcaaagtctgtctatgttgtaacacgtatcagtactttgtttctttttattgctgattaatatttcattatatggacatgaaacattttatttatccattgatgaacatctgcattgtttctactttttggcattgtgactaacgctgctgtgaacattcatgtgcaagtttttgtgtggacatatgttttcatttcaccaggagtggaatttctgagtcatatggtaattctgtgtttaaccctttgaggagctgtaggactgttttccaaagtggctgcaacattttaatttcctgccagcaatgtatgagggtcctaatttgtccatatccttgtgaacatttgttatttctgtctttttgatgatagccatcctagtggatgtgaagtggtgtctcatcgtggctttgatttgcagttgcctgatggctaaggatgttgagcatcttttcatgtgtttattggccacttgtatgtcttctctggagaaaggtccattcacatcctttgtctattttaaaattagggtatttgtatttttattattgagttgtaacagttctttatatattctagatataagttccttatatataatctgtgctatcggcatttgggaacacatcattctttgttgtatgtgggagctcctgcccactaggtgccagtatcactccctaacccctgcccaactgtgacactaaaagtacctccagatattgtcaaatatctcttgggggcaggggcagaatcgccctggttgagaaccactgatttagagaaatctagttctatttctgtcccctgtagcctgtttaatcccttcccttatggcaagcattcattcttttttttcttggttcatcttcccattttttacatataagtaaagctgtatgtctttgtcatccacttcccttcttagggaaatggtagcatactctacacagttttttcctgccttgcatttttcgcttaacactgtatgctggagatcaccccacggaagcacatagaagcattcttcactctttttttttatagcttgtaactcaaaccataatgaaccataacttaccagccagatggtacttttaagtcttatgctcagaaggcctaataccaatgaagggttccttatgagcctttaatataaacatatttcctgactaatagctgaaatggctgtgccaggaaaactatgggttttcttttctaagatatactttgggataggaagtgattttaccagtaggtgccactgttagatagtgttggcaaggttaattctttgatgattattctttactgggggtgtgtgtacgtgcgttaaaaaatttttacacatggccgggcgcagtggctcatgcctataatcccagcactttgggaggccaaggcgggcagatcacaaggtcaggagatcaagaccatcctggctaacatggtgaaactttgtctctactaaaaacataaagaaattagctgggcgtggtggcacgcgcctgtagtcccagctactcgggaggctgaggcaggagaatggcgtgaacccaggaggcagagcttccagtgagccgagattgcaccactgtactccagcctgggtgacaaagcaagactctgcctcaaaaaaaatgaaaaaaaatttttttttacacagagtaaaaaagttaagccctgcagaaaaaggtacagaactgtctctcctttgcccccacctcacttcggttcccttccccagtggcaactactttgatccatttctttctttctttttttcctttttaaagagatgggctgtctcactatgttgcccaggctggatattcacaggtgtgatcatagcgcactacagcctcgaactcctgagctcaagtgattttcccacctcaacttcccaagtagctgaaactacaggagctcagctgatgcatttctttagttatttcagagatttgtgtgtgtgtttttgtgtgtgtatacccacttagccacacacatatgaatatgtattgcgtttaaaaaaaagatcttggctaggtgcagtgtctcatgcctgtaatccctgcacttttggaggctgaggcgggaggactgcttgagtcttggagtttgagagcagcctgggcaacatagttacaccttgcctctacaataaataaataaaattacctgggcatggtggcatgcacctatagtcctagctactcgggaggctgagggggaggatcacttgagccccaggggttgagctgcagtgagctgtgatcacgccgctgcattccagcctgggtgacagagcgagaccctgtctcaaaacaaaaccaaacaaaacaactttgtagcatgctccagacactgttcccaccttgctttatatactgatcattccacatcaatgtgcagggatgtcttcggtgtgcttgctctgctgtatgctatatggctgcatccttatttatttaaccagtctcatatttagtttgtgtccattattttgctgctttaatttatgctgcaaattagtatccatgtacatatatccttgcacccacgcgcgaacacatctgcagggatagattcctagaaggggagttgctaagtcagaggatgtgtgcattttacattttgatggctcctatacacataagtgagatgagaacaataaaagctaattgctattgaacgtctttatggcctgcaatgtttgttggagaaaaatagccttaagagctagcacttgtatcgatgtgagaagtcttattaaaaaaaaaaaaaaaaagactaaggagatagaatcataaggcagcaagcaccatgaagcctgcagagttacttaagcttgagcaaataacagttactttgtggggactggtcattctggctgttctagctaggaaagtaaacagtttggaaaccaggagccttctatagggaatatttactcctaagatctcttcataggtcatcatgaccctcctttggcatgcatgattagtgctatggctgttgatgaaatcaatagagacactggcatccagaacagttccaagagaaagtgtctgttatacacataaaaagagaaacagatttttccctaagggttaaggtagactctttctgcgtctcagagtgcccaggagagaatgagtaaaatttattttattgtgtcatttctctgcttaatccacaaggtgaaattgaaggctctgggactttgcagaatacttagggttctatagcaactctggttttttgccctgcttcaaagtagtctcagctgccttctagatggtacataaccaagagcgtagctgttgctgacttacattctaaccctatatcaatcacatggctgctgctgacatccttgaccttgaatttggcttcagatctctccagtacatctgtagtgtagttcacagcactttggactttatattttgaatattttcagcttttgaggcatatatatatatatatatatgaatgaacaatctcaatctaatgtgtaggcatgtgaatgtgcttaactctaagcatttcttttctgtttgttgaaaaaggtaactaaaaattctaaatttacataagatattacaccctgaagacagaattcatgttccaccttcaaaagacatcagcacacacatgcacacttggatggtggtatgggaaaggaacagggagaaattcaaagcattttaacgagatgcaaatggatatttgagattttggtatttgatattatttcagttttcattatttatcataggtatgacgtcatttatccctttttgatccaggaattttcagggttaagtgaattttacatctaccatagtagatttgtgaaacagtcacataattaaaagctgatttgggtgaaagttgatttttgttatacatgaagtataattgattaatgcataacattttcctgcctttagttgaagccctgtttaaaatattttcctcatctgtattatttttcaacaacttcatatggagtgcaaattaagaggtgttgaaaacaaaccagatggcccacttagaattatcttttaggcaattttgattactttgaggattttcttgcatttagagtgttgaagtaagcatctcctgactattacaaagatcatatagaaatcacttggaggttagttagggctaaaaatcctttttcccataaaagtagtcattaggaatacagctataggccgggtgtggtggctcacacctgtaatcccagcactttgggaggctgaggccggtggatcgcctgaggtcaggagtttgagaccagcctggccaacgtagtgaaaccccgtctctactaaaaatacaaaaaattagctgagcgtggtagtgggtgcctgtaatcccagctactgggaggctgaggcaggagaatcacttgaacctgggaggtggaggttgcagtgagccaagatcgcgccattgcactccagcctgggcaacaagagcgaaactctgtctcaaaaaaaaaaaaaaatgcagctataatatgggttaaatagctttttacagaccactctgggagcctaatactcctttgatactgtctctgtggggatagtaggtttagagttgacatcagactgttggctgaggtaacttttttctactcagagaaagaaaagttcttgcctgggcacggtggctcacacctgtaatctaagcactttgggcagccaaggtgagaggattgcttaagcccaggagttcaagaccagcctagtcaacatggtgatacctcgtgtctacaaaaaaataaaaaagtaatcctggcactttgggaggctgaggcaggtggatcacgaggtcaggagattgagaccatcctggccaacttggtgaaatcctgtctctactaaaaacaaaaaaattagctgcgcatggtggcacgtgcctgtagtcccagctactcaggaggctgaggcaggggaatcgcttgaacctgggaggtggaggttgcagtgagctgagattgcgtcactgcactccagcctggtgacagagcaagactgtctcaaaaaataataaataaataataaaaaataaattaaaaagttagctgggtgtggtggtgtgtacctgtagtcccagctcctcaggatgctgagatgggaggatcacctgagcctgaggaggtcgaggctacagtgagccatgatcatgccactccactccagcctgggtgacagagtgagaccctgtctaaaaaaagaaagaaagaaagaaagaaaaattctcctgaaagggaacccttgcacactcttggtgggaatctaaattggcattactattacggaaaatagtgtggaggtgcctcaaaaaattaaaaatagaactaccatatgatccacttatcccactactgggtatatatccaaaagatatgaaattattgtgttcaagaggtatctgcactcatgtttgttgcagcattattcatagtagccaagatacagaatcaacctaagtgttcactgatagatgaatagataaagaaaatggaaaatgtggggtgtgtgggagaaatggggagatgttggtcaaagggcacaaacttgcagttataagatgagtaagttctggagatctaatgtacagcatggggaccatagttaataatactgtaatcccagcacttcgggaggctgaaatttgcttagagagtggatcttcattgctctcatcacacacacacaacagtaactacgtgaagtgatgaatatgttagcttgctcgtggtaatcattccacagtgtatacagagatgaaaacatcttgttgtacaccttgaatatatacaattttttttttttgtcattctgtgactcctacaccttcttactccctttgtgaccttgggtggactcagcatggtgaccaaagactttcatgatctgaagtgggtgtgccctcttcattcctcatacttgacattccaccccaaacatggtgtacacattctttaaacagccttgcatttgggcatgatgtgtttgcttgggctgttttctctctttctgaatgcccactgctgcccctttcctgcatgctcccctcaaggttctttctacagagcccagttgaaatgctacttttttgatgaatccttcccctgacctggtcccaaacttactgacttagaatctcagaggtctggaaatttgtgtctctcatggcatcttgtatagtgccttgcccataataagtactttatatatgttggagttgaaatagataatgtatattaactctgcgaggggctaattgatacctagaatgaacataggctaaaatgagaagctagcatgagctagatatcagaactgaacaaaacacacaccacaaataataaaaactcaaaccatagactaacgttggttgggaatgaagatatgaaaaatctcaaataaaatattcgaacatccaatttaacagcattaaagaatgatcatgactgagtagtgtgtttatcctgggaattaaattaacacattatattgattgaacaaaagagagagactgtgtagcgccatacatgctcaacatcgaaacctggtgctcacagtctcataatgaactaggaagacaccagtacttcttaaacaagaagaatatcttccacaaagcagtagccaacagtaaagttcatggtgaaatagtaagggattcttattacaactagcaacaaataaaaaatgtgcaccatcgtgaacaaaacagttgttaaaatgagaccagcaaatgctctctgggaagtgaagctggcgttctccttcctgcctgtagagttatgaatccatacaaccttttgggaaatcagttaggtggtctgtttgacaaaccatacaaatatccataccctctgactcagacatttacttctcagaaattctcctaaggaaatcagaaatgttgacagaaatatgaataggtactcattacatttagaagaattagaaatgacaacaatctactcatcataacatttggaagaatcggaaatgacagcaatctaaatgccccacaatggggaaatagttaagattattatggggtatctgtacagtggaatgtaatgagtcatgagaaatgtttaagagttttaataccatgagaatgctcttgtgttgaattagaatgatacaaattgtatttaaacagtccctcaactgtttataaaaatctcctctgtttcttggtgggttagaaatcacctttttttttttttgagatagagtcttgctctgtcacctaggttggactggagtgcaatagcacaatcttggctcactgcaacctccgcctcccgggctcagataatcctcctgcctcagcctcccgagtaactgggattgtaggtgtgcgccactatgcctggctaatttttgtattttttgtagagacagggtttcaccatgctgcccaggctagtcttgaactattagactcaagcgatccacctgcctcagcctcccaaagtggtgggattacaggcgtgagccactgcgcccggccacctttctatttttctggttaactttctaaatgtttgaaatggcttccaatgaatttcattttattattgggggaaacttccacacttattttctttcttcccaaatctccacaagtatactctcctcccaaaatttagatagttgtatttttctgattattccaaataagagtgctgagaggctaatcacaaagagcagcagccagagatttacaaagtgttctcttactattgaacattttcacttattctttttgataggacacacatccatatggctcagaaatcaaaatgtccaagaatttgtcaagtgaatagtggctctcttattcctgcccccccatctgcccagtcctcttgaagcacgtaaccaatgataatagtttctactgtgcacttgcagagattttccaggaaatttcaagcaccttgccttccaagtcactatataccagctactcatctcgtgcccagttcactttggtcaccctgtccccaccatccctgtgcttacatcaaccggtacttctctctctctgagctcaaacaccccagagagaagcctggccctgcccagccttttatgggtagatgaggtgggagcatgggtacgtgttcctttgcccacctcggagagtcatccagcttctggaaaaatgatagcagccaacttgacagaagaacccagcatacacattcaagttcattagattaaaaaaaaaaaaaaaaaaaaggccgggcatggtggctcatgcctgtaatcccagcactttgggagacgaaggtgggtggattgcttgagcccacgagtttgagaccagcctgggcaacacaggaagacccctgtttctacaaaaagtaaagaaaaaaaattagccagtcatggtggcacatgcctgtagtcccagcttcttgggagactgaggtgggaggatcacttgagcccaggaggtcaagactgcagtgagccctgaaagtgccaatgcactccagcctgggctaccgagcaataccctatctcaaaaacaaaacaacaacaaacaaaaaaacacaaaaaaaccctgaaactaaaaataagtcaaaggcagtactttgcaggcagttattttcagcttgaaggtagagccgtatagcagaatcttggagagggcttatgttgtttgaaacgccttcagtatcatcattttctacactttgaaagtggaaatgggccgggcatggtggctcacgcctgtaatcccagcactttgggaggccgagacgagcggatcacaaggtcaggagatcgagaccatcctggctaacacggtgaaaccctgtctctactaaaaacacaaaaagaaaaattagccgggcgtggtggcgggcacctgtagtcccagctactcgggaggctgaggcaggagaatgccgtgaacccggaaggcagagcttgcagtgagccgagatggcgccactgcactccagcctgggcgacagagcgagacttcgtctcaaaaaaaaaaaaaaaggaaagtggaaatgatcccatatctttctgatgttaactacagaaagtatagtgtggcagtctgggctctagagcgcgaggtaaaaataataaatggcttgaagaacattgttcaaaggcatatcatgtacaattgggtttttgatggggagggcagcagtggggttaaaaaaaatctcatgtctaaagcacagatatgtgcacagcacataaacagatgcacaagacatctctggagttaaaatttcctggggggtggcgattagaaacaagtgtttaacaaagctccttaggaggttgataatggcttaggaaaggttgagagaggccgggtgcgacctgtaatcctagcactttgggaagctgaggcgggtggatcacctgagattgggagtttaagaccagcctggccaacatggtgaaaccccgtctctactaaaaatacaaaaattagctggatgtgggggtgcacacctgtaatcccagctacttaggaggctgaggcaggagagttgcttgagcccgggaagcggaggttgcagtgagccaagatcgtgccactgcactccagcctgggcgacagagcaagactctgtctcaaagaaaaaaaagaaaaaaaaagaaaaagaaaaaaagaaaggttgagagagactgttcaaaggcaatgggacccaatactgatactttgatacttcatgggtgttttgcggaggagagttgcgaggataaagaagaaataaaaatctagcttccggggcactgctgtgaccaggctattagggtcagcttgagccattggtaacttggacaaacttgaacgttaacatttgaactcttatctggtaaggggtagcagaaagttcccttccctccttgaacgttaacatttgaactcttatctggtaaggggtagcagaaagttcccttccctcctctgcacttcttgcctccatattccacactgttgtcacttcaccccctgcatcccctagctggacgcaaaaagtggaacttgaacttgagggctggctgttttctcagaatacaggatgccaagagttgagagggcccaaggtcttcctgtgatcttttatattacacgtcacatgccagtaccatggcgttaggctggtagacccgaggccacccggtcagtgatgagtggggccgcctctaggtcctgtgttccttctgttccccgtcgagggtcattcattaagaaagcacagcgagtgctgggagatagcatgacgtcaactgtctgtttgtgaagtgtttttcttgctcgctagtggatagtgtgagatcagagtggaaattggagatgacctgagcactgaggagttaaggaaggagagcaagcaacagggtgattctggtggaaaagtggagcaagggagttggtttggcatttctggattcttttcaggtctcccacaccatctttgtagttttcggcaggatcacagagctatcttggccctcacattttatttttttatttttatttttattttgttttatttttagacagggtctccctctgtggtccaggctggagtgcagtggcgtgatcatgtctcactgcaaccttgacctcgggggctcaagtgttcttcctgcctcagcctccctctctctctctctctctctctcttttttaaatctatagaattagttgaatcagactaaggttactttcaagtctattatgttatgaggtcagtacttaacaaagtaaggtatgtctaataatttctttattaataataactgaacctcacagccaggttattataattgcaaagaattaaaccagagactttgggggattccacataggataagaccacagcacaggcgctcttcctccagtgctcagggttctattttgttttctccttcactgggatatcttttttactaatacttggaattcttcaaaactaacttctccatctccattcttgtccagttcttgaaagagatcatctagggtgtttggaccctgttttacataaaaaaggatgggagaagggaggggagaaaaaatgaatcagttactgctacacattctcagaaattagaggccttggggtctgtgtgccaagaaggcagctcaggtttccagtgacatgcatctaatagctaacagagagaaaccagctttagctgttgtattgctccgtgtcatagaactggctacctttttgtcctccatatcacacatctgttattttaatacaatgcgtattttaatacagttgttttcttatgcgatcttgggtctttttctttatgcctctaaaaacattcttctgagaagggatctgtgggcttcactggattgcccacggcacacaaacagttgaggacccctgccccaaggttttcctggaagctgggtttgtctcctgctccagggctagggctgacatattacatgaggcagcaggcagggagggctccttctgtaatccttccgaccaccctatgagggagatctactttacaggtggggaaacaggctcagagacaggcagtcacttacttgagtgtccacagctggttaacagaggggttggggtccacacgttgactccagagctcaaccccttaactaaccaccgcccagtttttcccaaacgttgagctatgcaaaatgactttggctcaatggttcccatgctttagcatgcatcagaatcacacgataggcttgctgaccttagtaaatacagactgccagccccacctccagagtttctgattcactaggcctggggtggggcccgagaatctgtacacaaggtcttgctctgtcacccaggctggagtgcagtggcatgatcacagcccactgcagcttccacctcctgggctcaaatgatcctcctgcctcagcctcccgagtagctgggactaaaggcgtgtgccaccacacctggctaattttttaaaagttttaatagagacaaggtcttgctgtgttgttcaagctggagaatctatattttcaacagcttcccaggtggtgccaatgctgctgctctgggaccacacttggagaaccactgcttgagatgtcgtgtgagatcgtgtgcaggctttttgactactggacttcctgcagtgtcttaagtggagttaatttttgtctctaccataaaactctaatcttaaagccattactacttggactttcaggtaggagtctatctgtgcaaaatactacttagaaaaccgattgaaataacagttcagtttgtcagtttcaaattagactatattatatatatatatgtatatataaattgtggtaaaaaacacataacattgaatttacgctcttaatcatttttaagcatacagttcagtagtgctaagtagattcacaattttgtgcagcacatctctatggaagatatattttaacccctaagattcctacaaaaacacttagcactttgctttaattacaagaccaaactgtaagttacttattcagcctttgatttatgaatatgaaacactgttttcctgaagcctttactagattctaaaccatgcatggtgatgatatatgtaaacagagtatggtggaaaaccttagtaatggaaaccttatgggaatataatcaggtacatgttaagtagactttcagaacttaccattagtcttcctacctcgttccagattatgtcttacgtactttttgtaggaaagacataaaatatagaaaaagttacccgtgttaccttttgaaacaacttgtttgagtacatggcctaggctttcctgttagatgattatttttcttccttttagaaaaaataaagggtcttttaaaattttaaattttttcactaacttgttttgctgtttaattaaaaagtccctttttctgctagtgactttaagtgtttttacaagttcttctatatttcaactatgagaaaatgagaaaatatcagattctggggtcattgaattcagcttttttcttttttagtattaaaaacagaagtctttccaattgtcatattggcagaagggacatttctggttaaaatctggagagctggttaaaatatttgaagaaatgttctttcctgaagttagagctaaatagtgactgagtcatacaaaacaattccatagtcacttctgttgtgaagatggtttttaattgcaaaatgacaatgactctctcctttgagtcctctgctcgactaggcctgaccttgggcttccctctctgtccttgtatctgactacccttaatatttgatcacctggcctgccttcagctagaatcctatcaaggcaatttagccagaagctccttatcctggatatttccttggtaattttccatccactggccccccccatcctgctctatggtcataaacccccacttatcctttctggagttgagcccaatctctctccccatggcaagaacacgtttcagtggtccctgtatgggtcgccatggccctcctggagtaagttgccttaccatccttggcaagtgtcctgactcagctttttctttagcaaaaggaaagacagtactgtatattggagtgaggacgatcagctcttctctgtactctgttgccttgaatgcattttgattttgacaactctggggtgattttgatgtgaaactttatggcccaggaaatttagtcctttcttgaaagttgtttagaaatgcacggttgcctcattaacacaaatttaagtgatgaacacaaatgtaaatgcttttgaaatataaatgagtgctgacaaggcaatttgtcagtgggttttcctaacagactgctaagtaagtgttggtcttgttgagggattttacatacacaaatgaagcctgtccaaggccagctaacactattttgcagtcctctttgttttcctaaagcctggcacagaagtactgaatccatgctgaaggccttattgggtttgcttggtgacttgtgggtcttccaggcataacttggcattgcttccatttattatggctagtcctgcagagtcctgtgctgaggctgcaggagggatagaaggcttggcccttgttttctgagagcttgccttctgaaatgtggcctgacttaaggggaagaaaccccacctgcatgtgtcctccctcaagcgacggtccctataaggctctaccggagtcctctcccctccctccctcccctcccaccatcagtcccattaagtgggctctgcggatggccacttactttgagtaaactggggaattcagcctgaatcaatagcttcagttcatcctttgacaactggtctggatcaccttctttggctgcatatttttcaaaaatcctcttcagttcctcaggagactttttagtactcattctggtgtcttataaattgggaagaaaataaacttaccaaaaagctgaagtacagttttgtgctgagggttgtctgcaggattttagtgccattgggccatttccttggcataaatggggaagaataaggaaaagagaatgtcggggtcggaatggcaccagtaactactaacatgtttaaaaaataagcatcttaggccaggcacggtagctcatgcctgtaatcccagcactttgggaggccaaggagggtggatcacttgaagtcaggagttcgagaccatggaagcctggccaacatggtgagaccctgtctctatacaaaaattagccaggcgtggtggtgcgtgcctatagtcccatctacttggaagaccgaggcaggagaatcgcttgaacccgggaggcggaggttgcagtgagtgcgatgccactgcactccagcctgggtgacagagcgagcctccgctgcaaaaaaaaaaaaaaaaaaaaaaagacatcttagatagtatgttaaatgtctgttcttagagtacatctgttaggagatggtccctggagccaaacatttttattagtaattaatgacattctacactttttatgtacctgatctgcactctgcaggctgtggtcttgaagaatacttgaccacagcttctagcttctaagttacagggaatatctccagatggcataaactcaccttctctccagaccattatctttcacaccattctaaaaggaagcagagtattaatgcaaacagaaggagctctaggtagtaccaaaatcacactaacctggttgcccaatagtgaaacagctagaagaatcaaagaggagtttgaagagctgagcagaatcatgacacttttatagtctttacgggcacgccaccctgattatgaaaatttccttttgttggccatttaagggtaattattaatggtttttgaaactcaggcttaagactgcatgaaccccataattaagggcaagatccagtaaaggtccatctcgacagttgcttcatggttcagagtcgtaagcttggatttttttccccctgagattatattttccctccaatgtagaattatatttgctcacagttcacatttcataaagcttagatatagaggattcttttcaatttagttgcatatttaggctttaaaaaataactttcttcatatccagaaaaaataaatgctgccctgtgcggtagctcatgcctgtaatcccagcactttgggaggccgaggcaggaggattgcttgaggtgaggagtttgataccagcctggtcaacacagcaagacatttctactgaaaaatttaaaaaatcagccaggtgtgatggtacatgcctgtagtcccagctactgtagaggctgaggtgggaggattccttaagcctgggaggttgaggcaacagtgagccatgattgtgccactgcactccagcctgggtgacagagtgagatcctgtctgtaaaaaagaaaaaatgctgtcatagaaggacaatattacatagtttaaaaaattacggtatggccattgaagtccttctgatgtctttacatattagcagcttaaatatttgaatacatgaatgaatgaatggaagtattgcttcagaagcaggtttaagaagtggaaagaagatactcagtaatttgtggttttatttggcaaatcaatattgagtaacatggtcattttttcagctctttcattatttgttggtcctgtgtctgctttttatttctcattatccttttccttaccaaatatatttcgtgatcattcgaaaaacttgtgagaacactcgacttactcttgttcagttggaaatacttcaaactttttgtaactgccatgatttaaaattgccaaggagattgatttctactggaaagagttccatgaaataagtaggacatttccaagggacattgatctaatgctgattgtaactcacaggaaggggttccaggtggattttaagagcactttacagctttgaaacacttgtacacttccacacttatagaattttccctgactctgccttatatcacctacaaactgaggactggactattgggactgtatttctccctgatgtttctcagctctaaaattctagggccttatttacattggagaacaaatgggaaatctaatagaattccttaaaagcttcccgccagtcttgagcatttatcattccatgtgtctttgctgtcttgtatatattcttcttgtttttattatggattctttgactttgctatgcaccaatatagaatatgtattaactcactggttggagtaaagacaggcattttatttttagttataagattttacacaaaaatattctgattttggcaatgcattttaatcaagattttagaaaattgccagtgtttttacacatatgttctgttttcctgggaggaagtaggcgtttgtgcttaatcataacaagaactatctttttttaaacatcttttaaaaaatatttcagatctacagaaaagtggcaagaatagtgcaatgaacaccagtctgcctttcgactagattcactaattgcgaacatctccacatttgctttctctttctctggacagatactttcctccacccctgagtcatttgagaatcaattacaaacatccagatgcttcccccctgagcacctcagcatctgtctcctaaggacaaagacattctcctatgtaaccacaatgccattatcatagcccacgtcaaatctctccaattgttgaatagcatcttaaatcatcttttctctcaaattaccactagtgagctaaaatcaaatggggtgtttattatgttttgcatctggtttttttgtttatttttttgaagccacttcactgtgtcactcaggttggagtgcagtggcgtgaacacagctcactgcagcctcaacctccatgggctcaggtgatcctcctacctcagcctcccgagtagctgggactacaggcatgtgccaccatgcccggatacatatatatatattttgtgtatttcttgtagaaaaatacaacatgggttttgccatgttgcccaggatggtctccaactcctgggctcaaatgatctgcccgcctcagtctcccaaactgctgggattacaggcgtgagccactgcacctggcctattttttgcatctgaagaaatgattttaataactatatgtcatcttagtaacgatataggatgaaagataacatgttctatataatacacccatatattacatatgacgtgtgtatgtatatataaaaattatctctaagaaaaacttttggagcagtattggttaatagtcttctaggctacaaatctcttctttcaagggacaacttctgattagaatcagcccaatgcggccgggcacggtggttcacgcctataatcccagcactttgggaggccgaggtgggcggatcacctgaggtcaggagttcgagaccagcctgaccaacatggagaaacctcatctctactaaaaatacaaaaattagccaggcgtggtggtgcatgtttgtaattccagctactcgggaaactgaggcaggagaattgcttgaacccgggaggtggaagttgcgttgagctgagatcctgccattacactccagcctgggcaataagagcgaaactttgtctcaaaaaaaaaaaaaaaaaaaaaaaaaaaaagaatgggcccaatgctgcctattgtcagaatttatacttgtagcgaatgctagcaaaacttgaacttgaaaaacagcctgtgcggcttcttaagtttttacttgctcacttctaccagtcacatctcttgtctcttatttttctctttacccatagacttaaaagcatgagggtaaacttgcacttggaagcatgaaaaatccactaatagatactcttgtgaaacattaactaaaaatatatggagacaagtgataattacagggtgtgttcacaagagtgcgttttgaaaccagagaaggggggaaacgacaggcacaagggtggtaatgggaaaatggagaggcaaaggttatttatcacctcactgttcaattgtttgatctttggacaggcttaatttttcctaggaaagccaagagtaacatattttaagagctctgggcaccacaggcttctgtgggttattctgcttgaaggtgacagcatgcaatgtcttgaaaagcaccttcaggaagagggtacagtgttagtacctggtccctgcaaaacaaaatgggtgtgaaatgctatccatgggttcttgttatctttgatcctgaagtttaaaagagaccttgaatactcaaatgctgctttcccagaaagtatagcttgcttgtcacctgacctggtgtctaccttccctggaccttcagacaaagttcacttccaacctttgcctgggctgtgaggctcactgtcttttgggtcagcctgtgctcaccttcagcagttgagttcccagaggtctcctgaccatagcctgtgcttcttgagtgcgtatctttactatgggcagtgtgctgacctaggcacccaactcccacggcctccttaaatccttgctgcaactttatgaagtggatgctgttggtccccccagtctgtagagacatccaaggacctgctcagggtcacactgctggtcagcagtagagctgggattcaagttcaggcccagcctgcaccctcaaccaccgtgccacatgcccctcccaggagaagggcttctctgaggacaaccattgtatgttaacattaggaccacaggtagtatcacacttaagtgttaggtttacatctggaggtataagaaggttctttttctgaggtgtaagaaagttcttttcctgatgaaaatgatataggcctttgtctgttttgcactgctataacagagtacctgagactggctaatttataaagaagagaaatttatttcctcacagttctggagggtggctgggaagtcccagatcaaggtgctggcatctggtgagggccttcttgctgtgtcatcatgtggtagaaggcatcacatgggtgagagagagggaaggggactgaactcatccttttaccaggaacccattcccatgataactaacccattccaatgataatggcattaatccattcatgggggcagagcccttataacttaattgcttcttaaagattccacctctcaacactgttgcactgaggattaagcttgcaacacatcaactttggggaatgcattcaaaccatagcagctttcttttactggtggggaaaaaaacaagtttaaaagactggaaaaatacatacgtacttatgggactgctcattgatttcctcattgtagattccattctcacactacttggtgacacagcagcgcaggttggaagccagaaatgggaaataaactgcttcaggttagaggcaggactctgtcaggcaggactgggcatagtgtgtactcggcctctgagtagggcaccacccctcccttcccgtctgctgaagagactcacctgcaacttgggacatccatgagtatctcagacacccctctgctactctgtggcccactgacccatcccttagtctcccctgttagtttttaatacacttaaaacactgtgagattccaggccgggtacagtggctcatgcctgtaatcctagcactttgggaggctgaggcgtgtggttcacagggtcaggagatcgagaccatcctggctaacacggtgaaaccccgtctctactaaaaatacaaaaaaaaaaaaaaaagttagccgggcatggtggcgggcgcctgtagtcccagctactcaggaggctgaggcaggagaatggcgtgaacccgggaggcggagcttgcagtgagccgagatcgtgccactgcactccagcctgggcgacagagcaagactccgtctcaaaaaaacaaaaaacaaaaaacactgagagattccattattgagtacttgatctgaacttgacactgtgtcgaactcctcagtggagatggaaaataaaaagatctaatccttgtgcttgatgagcctacacttaatttatgagaggagatgcatttatgaaataatagaggaagttaaagctgtttgtagtaaataacggtattagattcctatggctgttgtaacaaattaccacaaacacagtggcttaaaacacatatacatttcttctggaagtcagagatataaagtgggttggcagggcagtgttccttctggagggtgtacgagagaatccatttccttgctttttccagcttctagaggccacttgcccacggccatcctccatcttcaaagccagcagcatagcatcttccagtctctctgatctctgctttgtggtcatatccccttttctgaccctgaccctcctgccttcctgttttaagagcctttgtggttacaatgggcccaccctgataatccagaatcttcccttctcaagagcctcaatttacaggctgggcatggtggctaattcctgtaatcccagaactttgggaggccaaggctggaggatcatttgaagccaggagttccagaccagcctgggcaacatggcgaaaccccatctctacaaaaaaataccaaaaaattagccgggcatggtggcatgcacctgtggccccagctacttggaaggctgaggtgggaggatcacttgaagccaggagtcagaggctgtaatgagctatgatcatgccactgcaccccagccttggagacagagtgagatcctgtctcaaaaaaaaaaaaagatcctcaacttaatcacatctgcaaagtcccttttgccacagattcataggtttcagggactaggatgcggatatctttagggtaggggaggcattattcagtctcctactatgagttactgaaaatgaattgatgatgtataggttatttatttggtaggctgagcataacaatggcattaattatgaggcagtaaggggaactggagggggcccctaaagcatgaggaatgggagggagaaggtatcttgggaaaagtagagaaggaggtggtctgtgtgtagtatggtggtgggtaggagagtggaggtgccattgacaatggccccagctagctgtggtagaagctacaggttcgaatacatgaggagggcatggctagtctgggctcctgtgtgaggtaggacctgagagccacccagaagagtttaggtttagtctgtagtgatggaggctgctggagctagcagtgcaacccaacattagggaaagtaatgctgatgtaaaactgcttgatactttatgtacaatttgaatatgacttagaatcaaaatcagaatcaggcttgaaaacctaatgagcagtaggaaaggaatgaattggagaatacttgtaaagaatactagaggaggccgggcgtggtggctcatgcctataatcccagcactttgggaggctgaggtgggcggattgcttcagcccaggaattcaagaccagcctgggcaacatgatgaaaccccgatgctacaaagtggaaaaaaaaaatgctagaggaaattgctgtatgttgcctaagagtctggaaatagaaatagctgctggtgagtaggctttccctttgtctccaggtgaaatattcaacgatgaggaacaaaaggaaagctgggcttaccagggtaggtcaggtaggtccagtcaggaatttcactgttgctaagagaacctaactcctgtagactttgttgtttaaggcacctgggatgctgtaaagtcttgaactcattacacttttattatgggctgcagaaaacatcagtaaaggttaattagtgccatatttatccttacatgctgattttacatctcctaaagctttatcacttattgatccttttttatttttctcatactatatggctcagttccaagagaggacaaatctggggatcagatgacagccagtatttaggctgaattagaggaagcaaaggcaatccttttgcaatggaagatgcgttttcctttcagatgcaaaaatctagagtattttggaaatgttggtgttaaatctaaagcatatttgagattattttctttaaccaccccagtaacaataaaatagatatgttttgaaactgtgatgttctcctgtctctcaggcttttagtggaaggaatgcaaggaacaaagacatttttgttaatttttgctgctgaatcaggttgcttataacccaagaggcagccagccatcatcatcttgtaggatccagcttgtaggatcatctgataactctgcaaggcagctggtgtgtcaggcttgggcaccatagtctctgccttgccctgaccttccgcttcctgagtgttggggttccaccagctggtgcctggcagcgttctttgcctgagtatgtgatggtgattcccagatgagatctcctaagctaggcccacacagaaccttcctgttccctccctccatcagcgacttgcctgtcaattctctccctgcttttctcctttcactgatgttcagggcaacatttggtactggagacctattttcacctgcttcccacctcttctctagcattttttgccttctccactggttcctacgctagcatgttttaatcagaggatcacagtggcatttataccttggattttctttctgtgctatcatttcaggagaaggtagcgtttattacttctgaaaacagcagggataatgtgaactaataccctagtgtaaggcctaaatactacattttactcttgatgacttaaacttgtattttcattagtaaaatacgatgtgcaaagtttaaaaagccaacagttctgaaaagcctataatgacaaagtcattaatcctcactccctctgtaccactctttagcttcttctagctctttctctgtgtttgtctccatgttgctaaataatctcatagtattctttgaggactttttagacttctcccgctttgttgaaggagtttttaatgctcttaggcagcccctatgcccactgcattttccttctctccccacctcccacccctacacttgacttttggaaatattttctggtcttcaagtgtttgtcaagttcatcccaagtaagcagtaaggcagatttcctgttctttttcttttcttttgtttacatttttgagacaaggtcttgctctgtcatccaggctggagtgcagtggtgtgatcatagctcactgcaacctccgcctcctaggctctagcaatctttccacctcagcctcctgaatagctgggactgcagcctgtgccaccacacccagctaatttttgtattttttgtagagaccatattgtccaggctggtctcgaacttctggctccagtgatctgtctgccttggtctcccaaagggttgggattgcaggcgtgagccactgcacctggcctcctgttcttagttggctaattttactctaatctcaatgcttcataccagaatatttcttgaataccaaccttgccagtaactgaacaaactacatgtaaagactcttcttgggtattgggtattgggacccaacacagtgaggaagactgaagagtcgtagtgcacttctatcaagaaattaggggaggttatccctgtagtctgcctagatggttcaggttgtctgaaacttaaatggaagttgaggctctgaatacacgtaggacttctgaatctgtggcaggtggtgcagtcttacctgatttagagaatacatagagaggccaggcatctatgtgcaactcagcttcatcggccagaagtgaatgccctatctcacctcactccagtaatacttaacctagccataattagctaaccaaagataggaacaagatgccaaggccaagagcacttgagaattgagcagtccatctaacaagggaggtcatcgagtttcttctccaccctttccctgaagtaactcttggagcaagcttgggacactgtgttcagatggctcggaaagttctggggcactgataagatcagacattttgttgggaattttttacctcagaaaattccagttgtcaaagattcctgtagagcaatatgtggcaattacggtatgggaaaaaaacaacaacaacaaatgaaaggttttatgagagggaagctcaagcaattccattagaacaggtcgactcacccaactgtagtctgttctaacaactttaaaaaagaagatgagatgaaaccatgagatcgtagtgaacagaactgagaaaacagatgaattacgagactcaccaggataggcttttcataaaaatcacctgtttctcaatttctgcagtgcgattgtgatcataaatataaagccactccggctctcaaagattgactgtctctcccacaaagcactcgccagacacaaactgagagaaaggcagggatggggaagaacctcgttctgtgagggcacagagagaggaccctgactcagctatggctcccagaaataccagctcctggagtggctgatgttggatagtggagctaagatttcagggttaagcatggtttcatttaggaaaagagggcagaggaatgggaggagattgtccaggcagagggcacagtgtgggccaagtcgccacggcgggaggaaaggagatgcagttgaaaaactcaaagaaccagcactcagggtgagaggggcagggaatataagataaggctggacggttaggctggcctgataccatgaggtcaagggtttcaagcaggaaaaatgccgcactaagatttgctgtgtgaatagaccactctgcctgcagtaggtagggtgtgctggggccatgggaatgttgagtggccagtcagtgagccattgctgtagcctgggagaaggctggagagaagtggatggatgcgggaattctggaggggataaatccacaggacttgacagagtggctatgagggagagggagcgatcaagggtgccacttaagtttccgacctacagagtgtgctagactggatgatacttctttctttcttttcttttcttttccttttcttttcttctttctttctttctttctttctttctttctttctttctttctttctttcttttcttttccttttcttttcctttctctttctttctttctttctttctctttttttggaatccctctaatggttttctataaataggttcttttggtatacctttccacagtacaagtactgatagatttgcttatggaaaatctttagggaatgcactgggcagtgggggaagagggttatcatgaaagatgtgaacaccgaagtgggaggcctcagcaatccagatctcgaagtgtgaggactacttggaactgatggtttgagtaatggcaggagggacatcatcaagatgctcctgatacattgttttataagtgatttaaatgaaagatgagaagcagatggaaaggaagtacaatgtgcagtgtgtctatgtcatgcctgtatttgaacatgatcgttggaaagactgatcaaatgttatagtttagggaccatgcttacccaatgatcattcctttaaacgtaaagcttgaaatttgggaaatgacatttttacaagatggcaaaactggacttgttttgttttctaaggtgattgatatgcccgagcacaaccctggcaatttgggaggaacaatgagactgggaataagaagaactgttttcaaaactgaaaattcaatattaagtaagtttcccatattgtttattttacaagatgttggatgtggctcatgtgactgcaggtgcccagcactctgggtggtggagactccccctgccccttccagcatcctcggagggccctgattctctctcttcccatctcccctgccctcactgaccctctgctctgggcattcttctccctagtaagcttgtcccttgggctggcctcagtagaacacactgaatgcccctccgcatttgatctgcgtgactccctgttcattgggctgttttgtgagttaccgatgctcctggagatgaacttggactgggacttggactg

SEQ ID NO: 5514 - DNA, 202322 bp, human; identical to SEQ ID NO: 3121

SEQ ID NO: 5515 - DNA, 202322 bp, human; identical to SEQ ID NO: 3121

SEQ ID NO: 5516 - DNA, 206581 bp, human; identical to SEQ ID NO: 3120

SEQ ID NO: 5517 - DNA, 206581 bp, human; identical to SEQ ID NO: 3120

SEQ ID NO: 5518 - DNA, 206410 bp, human; identical to SEQ ID NO: 3123

SEQ ID NO: 5519 - DNA, 206410 bp, human; identical to SEQ ID NO: 3123

SEQ ID NO: 5520 - DNA, 75301 bp, human; identical to SEQ ID NO: 3122

SEQ ID NO: 5521 - DNA, 169078 bp, human; identical to SEQ ID NO: 3126

SEQ ID NO: 5522 - DNA, 169078 bp, human; identical to SEQ ID NO: 3126

SEQ ID NO: 5523 - DNA, 73116 bp, human; identical to SEQ ID NO: 3129

SEQ ID NO: 5524 - DNA, 360571 bp, human; identical to SEQ ID NO: 3136

SEQ ID NO: 5525 - DNA, 360571 bp, human; identical to SEQ ID NO: 3136

SEQ ID NO: 5526 - DNA, 115413 bp, human
ggcggcagtggcggttgcggggcatgcgcggctccgcgcgcggcttctcaaacatggcggcggcggtgtgaagctcggtgccggctcgcgcgatcggtgggacagaatttcgttgttttcaccgacgagactggaggtacgtggtgattccgggccccgtaaggaatggagaggcggaggtgtgtcccggaccccgaccgttgtccgtgggcgggcgggtagaagccatcagcgcgcgtcccgtgcgaggaacgcccccttacgatcccgcctatgtcccatctcagttcggcttcgcgatagggtatcccgcccccggcgccttccgcggacgcccttcagccgatctcgcgtttcccctcacgccgccccggggccttttcgccgccgcggggtttgggcgcccggccgatagcttccacccgtcccctcgcctgcagcgccgacagcgccctccggcgcatcctccctgccgtgggtagggccgggctggggcctggggggcatcacggtgggtggcggggcggaggaaggaggtagactttgcctggtctgggctgagataacttttggagtttgggagggaaacgtcggcccggaaggatgcgcctgtggcggcgtgcgggcgcaaatcctggtgccaaggtgcgcgccgccgggctcctggcgggggctgggggcgccggtggctcaccctagcggtgcagcgggaccggaatgcgcgtcccgtccggggctggcggggaggcgaggaggggctctaagcctcctgaggggcggagaggcggcctcgcggcctgaccgaaaaaaagttgctgccgtcacttagaaacagtctcgaaatggtttcttacctttctcgctttttccacctgtatcgtgcttgcgccccatccaggtgtgaagagccggagggagaatgggtctaggcgaatttgctcgattttgcgcctcaaggttgtacatagatagcttcctgggccgacttgtaattcggctcccccaaaccccaaatgtttgggcagcacaagtatttacttacaggctcccatttgagactatttattttttaaaaagaggttgttaaacatttgtcaagcatcacaaagtgtgattgcaacttgaaatttgcttcttgtttgtaaattaggagattaacgtttatgacttactttaggtcttctctggaaagttaatggatcgattagtgggggtaaactgaggcagggaaagtgaataagttgcttatgatcatatgatttacaaaagtattggagatagttgtttttttccctaaaacagcttcagatgctgctacattttaatgcccccagagctattcatatttctgttttgagggaaaagtattttaagatgtacaacatttatggagtacagctgcctatgatgagcaattgttttataacaatggttcataaacgcatatttaattcttttcaataacagcgagggaaatgtttttcaataatgacgattttgcctttcttttatttttcttaattactcattaaataaaatatttccaattacgaatgtgctttcaggctgtttgtgtgttttttttttttttttctatttaatgggaggaatgtgaaaataagcttttggaaatgaatccagtgggatttttgagaaaagattgagtttatgagtattcacctgatgccttgtgtttagctttatctataacctttaaaacagtttgatagaatgtaaagaaaaaacaccatttaaactggctttgaaagttttgaatgaactttatatatacatcatgcagccatatgaacttcttaaggatgtatacttgtttaccccagagaacctgatttgctttggaattggtagttggaaaaaagattactgtaactctactgcattatatgtgcgggtgctttaaagttgatagtgtcataacgttcaaaaatcattacagtcagtctaaaaaaggtgtatcagtttttctcatgaggtggttgatcagtccttttgatttatgattccatcaacacatctttattaagcacctgtgctgtctttactatggagttcagtttattcagagcccactacgtgtgctaatttcagggtgtttaaggctttccacccatagtttattcctgaaaatttcagggagttatagctaaaaaaatcaatacgaatgtagaacaagtattcctttcattcaaagggcgaactcgagaagtcagtatttttgtcataattctccaaacaaaattctgagtgtagctgcaaactatttctgacttacgtgatgttaactttgtgattttttggttaggattatataaagctatatattttcatgagattattttctggttcaaatagataacatactggttaagcttgaggggaaaaatgagttgctggtataaatggaaatcaatatgtgctctgaagattgggtattttttaatactaagcaatttctattactaagtagtttaagctgtaattaagttttaactggtattttaaagcactttgttttttcaaaatgttgcagaaatctctgagctcagaaataacaaataagggttatgatcctcagctataagccagatgtgactcttattttcttttgggcttgttcctttttagctgcctgcctgttcctcccagatgcttcctatcacccctcttcctgcccctgttccctttgctgttggtgtctgtttccgcatcagtgaaatggtcagggtaatcctttgctgcttcactgagaaataattaatgatggtaaagtgccttgaaaaggctgagtaaataccaagtcttttgaattaacttgatgtagccacttgttccatttaaggaagagccaaatcccaattttagtttgagctcttgggggtgcgagagaaaagtttcacttgactattttactgcctttcttttggggttaatagcaatgacttttgtaactctagtaactggaacacgggtggatacagcagtatcctctgctgtttgccttattagtcacctctagtcttttttttttttttgcctggttattctgtctgccatttttctccctctattctcattccacttgtgaatggaaatcggaggtcctctctattagctaccctctcggggtggggagggtaggtctcactgtctcctcatagtcatattcctgatttttaggatatacaagaacaaagtgggctctgccagctatcagccttagagctatgagctgtggtgcaaagattagtctgtcattgccagaaggtgttttgtagtttgcagtgggcaaatcaagcatccctaataattttagaaccattattaatgtctgagaattactacataataccttagaatttgaactgattgttgattccaggaactaaaaacctggacattttgaaaatggcaaatgttggtgatgtttttttttttttgagatgggctctcgctgtgttgcccaggctgtagtgcagtggcgtgatctcagcccactgcagcttctgcttcctgcgttcaagcaattttcccacctcagcctcctgagtagttaggattacaggggtgtgccaccatgcccagctaatttttgcatttttagtagagacggggtttcacctagttggccaggctggtctcaaaactcctgacctcaggtgatcctcctgccttggcctcccaaagtgctgggattacaggtgtgagccaccacgcccggccgtgttggtaattttgaaggaagagtttatacccttccctggctttggggcttaatattcaggatctctttgtcttggggaaatagataaaagaaaccactggcgtttatcttagattaaaatggcataatttataccattatataaatactggtataatttagtggtaagtacattttttagactctaagtaccttaggctttggttaccatttataaaaagagtttgtggtagttctttttttgatacggagtcttgctctgttacccaggctggagtgcaggtgcaatctcggctcattgcaacctctgcctcctggcttcaagcaattctcctgcctcagccttcccagttgctgggactacaggcatgtaccgccacacccagctaattttttttttttttttttccgagatggagtctcgttttgtcacccaggctggagtagagtggcacgatctcagctcactgcaacctctgcctcccaggttcaagtgattctcctgcctcagcctcccaagtagctgggactacaggcgtgcgccaccgagcctggctaatttttgtatttttagtagagatggggttttaccatgttggccaggctggtctcaaactcctgacctcaggtaatccatccacttctgctgcctctccaagtgctgggattacaggcatgagccaccgaatctggcctttgttttttttgagagtcttgctctgtctgttgcccaggctggagtgcggtggtgtgatcttggctcactacagcctctgcctcctgggttcaagcaattcttgtgcctcagcccctgagtagctgggattacaggcgtgcatcaccatgcccactaatttttgtatttttcataatttttgtatttttagtagagatggggtttcaccatgttggccaggctgttctcgaattcctggcctcaagtgatcctcctgccttggcttcctgaagttctgggattacaggcgtgagccacctcgccctgccaatggtggttcttaaaaataacttgaaaaaattttagaagctatcaagatttgaaatgtgtatgtgttctttggttttcatgagaaaggcgattttgtttattttgtcattatgttgtctatttctagggttaccttggcaaccttagaaataatactgggtttttttttgtttgtttttttttgagacggagtctcgctctgttgcccaggctgtagtgcagtggcacaatcctggctcactgcaacccccacctccgaggttcaagtgattctcttgcctcagcctcctggggagctgggattacaggcgtgcgcaaccatgcccagctaattttttaaaaaataattttagtagggacggggtttcaccatgttgttcaggctggtctcaaacttctaacctcaagtgatccacctgccttggcctcccaaagtgctgggattacaggcgtgagccaccacgcccagcctggagaggtgttaacataagcaatggagatatcttattgtgtgaaaagtgaaatatttgaggatcctgtagcagtgaatatgatggtgctgttcatcttaatatcatgatcatttgacctagactacatgaattccttatttgaagagttaaaacttatagaataagctgtgagtaaagacctgggaaactgaagatagcatttgattacctactacttgtgacctgtgtttatggctatggctctgcctcttcctaagtttataggagcaaattgttttaagaggggaaagagagtgcccacttttagtggtaacgtactgttgtaaacttcagaagggacagatatattacaattctagggcataccttgaagatgctttcatttctcagagaaaagtttgcggggctctctttggttgtgtttagaatacacatttgatttttcgcaacctctgtttctcataaagattaactggtggcgaattatagacaaacagctccatttgtttggtatgtaccttatagccttgacatagttttttaagtgtattgacaaagtgcttgttttttttggttaacatttggccacttttcctacctttcatcagttttagctggtttaaggtttgattatatatttatttttaaatgctgaatcaaatgtgtttcttcttttcagttctcttcctctttgaatacatttggaaacatgtgccctttgctatgaactgttgcttttttttctttggaaatattttttaaaatgttatttggagtatttttctctttaatgttatttgaaaagcaatatagtcagtattaatttttaactaacttgatagagtttcataaatctgttcaaatgaaacacggcatctttggtcattaaaagaattaatatatagtaggcaatagtaagtatatttagatattgtttggttttagattactttagagactctgatttgagattttttttgtgttgaaatttgagaagttgtagaaatatttgaatgggtaatttgctgacacctgcctcatgtttgaggtattttcaaggatgtttagttttctggtttcttcagattgtggtttattgcatgcttttctgcagtctgttgtctagtggggattgttgttgtcatcatttccattatttcttgtagggccggtgttagaaaccataaatctagactgcagtgataataggaacagcctgtaaccagatccagttcttttgtcaaaaagttgcaccattagctgcctgtagtatattgacatgccctgccattaactcaagtccttcacaaaagtcagtgggtagcaggtctttgggcagttagcctgtagctgtgctttaaaacctcaggaatttacaactataaactgggattttggcaacccttgacttatctttcgtttatctgttttctgacatgacatacttcttcactaaatacatagctttcacataaatcattttgaaattgcaagtgattaacttacaggttttttggggggtaacttaaattagaaatttttgaaaatagttaagccttcttaggtttgttttgacacagaaaaagattaattactaatttgttggggtggactctttactaaagcataatttaaaattgctcctttagaaaccttaatttcctcaagaaggcttgatttgataaattattgctaccaaaaatgttctttgatttttttttacagatttcagaaatatggagatgaaaatgttctttttttttttttttttttttttttttttgagacggagtcttgctctgtcacccaggctggagtgcagtggcatgatctcggttcactgcagcctctgcctcccaggttcaagcaattttcatgcctcagccacccgggtaggtgagattataggtgtgtaccaccgcagacggggttttgccatgttggccaggctggtctcgaacttcagacctcaagtgatctgcccacctcgtattcccagagtgcggggattacaggcatgagcccctgcgcccggcctaaaaatgttctttttttttttttgaaatggaattttactcttgtcactcaggctggggtgcaatggcactatcttggctcactgcaacctccccctcccagattcaagcgattctcctgtctcagcctgccaggtagctgggactacaggtgcccgccaccacacccggctaatttttgtatttttggtagagacggggttttaccatgttggccagtctggtctcaaactcttgacctcaggtgattcacccgcctcagcctcccaaagtgctgggattacaagcttgagccaccgcacccggcttgttctttcttaatattgattagtcttaattcagagatagaattttagttttaaatgtaattacagtattagaatttagtgtttttctgattacttttataactatgtcagaaaatgtgacatttgattatttacttgagtgaattgaatagatacttgtggaatcttaatgtgatgactcatgttcaattccacaaaattatgtatggttatacaatggaatatacactttttctatcctgtattaggataatcactattaccagaaacaaaatcttagttgaaagagagagcttctcttggtcaaagaaaaaatacataactacagtgtattttaattaaatcagtatttttttttgcatttaggcataaatgtgaagtacttcttgaaacaaaataataaactatttacaagttaaaaacataaaggtgttattttatgcagttaactcagaccttccccttcacaataaaggacagcgtttttgtttgttcaagtctaaaagtagtgtctttataacaagatagattttaaaaggaaaagaaccctttctacctgtgctatttaattaatctctggtaaattgtgtatgtataataacttccgtcacttattccaacattttctttaaaacaccagcaaacgtatttgtgaatctctcttatccttgaaacttcttatgctgttgataaactcaaggggctatgatgaaacatttttttcaatagattattttgtgaatagggacttggcttgttgtttctttttttggtgaatattggtttaaagcacatgttttagttatacctgttatgtagttggcatttataaactgaattctataatggtaactcatacggagcctgactttttgagaccatgaacatcctagaaagagataaaattcagagtaaaaaaaaaaggccaatcaacttctgggaaagagagagatattggaggtgggggattgtctcagatctcacagaattttctccttggcccattgacttagacttgtgtgtaaattaagacagctgatttgatattgcaggaaagaacagagaacaacaatgatggccaaaagaaaaatctcggccgagcgccgtggcttacgtgagcctgtaatcccggcactttgggaggctgaggcaggaggatcatttgagctcaggagtttgagaccagtatgggcaacttagtgagccatcgtctctactaaaattaaaaaaaaaaaaaaaattagttgctgagcttgttggcacatgcctatagtcccagctactttgtgtgtgtgtgtgtcgggggtagggggtgtgcagggggtgtgctgaggcaggacaatcacttaaggccgggaggtcaggctgcagtgagccctgattatgccactgaactccagcctgggcaacagagtgagaccctgtctcaaaacaaagaataaaagaaaaattttatcaaaaaattgttttagtccatgtgtggtggcttacacctctaattccagcactttgagaggctgaggcaagaggattcattgagcccaggagtttgagaccagcctgggcaacatggaaaaactctgtcactacaaaaaatacaaaaattagccaggtatggtggtgtgtgcctgtagtcccagctactagggagggtgaggtgggaggatcacctgagcccggggaggttgaggttgtagcgagctatgatcactccactgcactccagcctgggtgacagagagaccctgtttcaaaaaaaaaattgtttttaaaaaccacagtattctggttctatatagtttagatacaagcagcctatagcacagcagagtttactcattcagcaaacattttggggaccctagtatgtgatagacactgtgctcgttattctgaaggatataaagaagaacgagatgtgatactgcccccaggagcttattgtctagcacgggagaaaaggcacttacacagttaaacacaacaaaggcagttttagcacaatggttaagcattcatgaacctagattcaaacctagctgggtgatcttgggcaggtctttgagcctcaatatccttaactttcaaatgaacattaatggacattaataacagtatctactatgcaggcttgtaataagctttagataagaaaaaatacatatataaaagccttagggtagggtaccaggcattcattaatagcaagagctcagtaagtaacagatctgagtagtagtatcaccactgccaacaccattatcattgaatctctgggaacataacttttgttttctcctgccctcatggatccgttttgtctagggtatctggtatattataatatctccttgtattagtctgttttcacgctgccgataaagacatacctgaaactgggcaatttataagaaaaagaggtttaatggacttacagttctacctagctagggaggcctcacaatcatggtgaaaggcatgtcttacagggcagcagatgagagaatgagagccaggtgaaaggcgtttctctttataaaaccatcagatctcctgagacttattcactaccatgagaacagtgtgggagaaaccaccctcatgattcatttatctcccaccggttccctcccacaacatgagggaattatgagagctacaattgaagatgagatttgggtagggacaccaaaccatatcactccttatttctccctttcaaagcacatacggtgtattggagccttgtcttttggcatttgacaaacctcgatttgaatcatttttctttcactaccagcttcctgatcttgaggaatcaaaataacttggtaactgataagacagaagaggaggggagtcaaagatgacttctaattcagaaagattgagggtttgtaatgcttttaaaataaaatgcagaggaagaggagctcattttggatggcaagaatttggttatttatgtatttattattttattattttttttttagagacagggtctcactatgttgcccgggctggtcttgaacttctgggctcaagcgatcctcctgccttggcctcccaaagtgccggcattacgggcatgagccactgcacctggtcttttaaaaaaatttttattttttaagtttcccacaagtcatagggaatgagagtttggtttcgtagttttattttattattttttcttttcttttcttttctttctttctttttttttttttttttttaaatagaggcagggtttcactgtgttgttcaggctggtctcgaactcctgagctcaagcagtcctcttgcctcagcctcccatagtgctgggattacaggtgtgattgtaatccggcccaggtttttttttccttttctttttctttttttttttttttttttgagacagagtctcgctctgtcgcccaggctggactgcagtggcgccatctctgctcactgcaacctccgcctcccgggtacaagcagttctccctgcctcaacctcctgagtagctgggattacaggcgcccgccaccacacctggctaatttttgtattttttagtagagacggggttttgccatgttggccaggatggtcttgatctcctgacctcgtgatccacctgcgttggcctcccaaaatgctgtgttacaggcgtgaaccactgcacctgtccgtattttattgattcttatgttctctcaggttgaaattctacagttgtattcattttataacatctgaccaatggcctaaagttgaaacaggccttgggaaatctctctctctctctcttttttttttccctagtgaaattgaactgaacctggaacctgggatatttcttgctgtcagatttattcagttcctgtccttgtcaaaatgtttacccttactgaagatcactactcttcaggtagtgatctttagagactcaaggtgtagcttaccttatcttaaaaacaaaacaaaataaaaaaaaaagggaggtggggcacacgaaaggaaaaaaataaaaaataaaaaagagaaaagaaaaagaaaaaaactctccaaacaaaaaaccccagaaaataaacaaataatggaaaggccctataatcttagaattatagacccattagtttgttaaatagtactttaaaactgtttttctcaacagattgtagaattttctccagaatcagataagagtaatgggagttttaggcttaataattccactattaatcactgtttacattgtttaattgtgttgagaaaatggtttaaaacaagacttttcaaagcatttgttgatcttttatcagctcttaattctgtaacaagatacaatctgcaaaacaaatggttgtgtaaaagattgcagattgtccatacttgttcagagcttctagatgcaactgctagatttagtataactgtagtctttttttttttttttgagatggagtcttgctctgttgcccaggctggagttcagtggcatgatctcggctcactacaacctccacctcctgggttcaagcaattctactgcctcagcctcctgagtagctgagcttacaggcactcaccaccatgcctggctaagttttgtatttttggtagagatggggtttcaccatgttggccaggctggccttgaactcctgacctcaggtgatctgcccgccttggtctcccaaagtgctgggattacaggcgtgagccactgcgcccggcccaactgtagtcttttggtaagtgaaatttcaatgtcaggcgctatgaaatactattaacctaaccttttttttttttttaaggcttacttacatttgaatgttttttcacacagtggaattgctcctaatatgcattaagtgaagcaacttctactctttatgttgccaaaaacaaaaacaaaagcctgaagcttttaactttttttaaaaccaaaaatttttctcccatgtatcaaggcaagttacttgagggtcttttttgagcctttcttataatgctgaagcaggttcaaagtatattgaaagcaaagataagcttttttgcagttttccttgcagactaccactgtggaaatgtgtttctaaaagaacttcaggcttctaatttttcccagaaagagctgtgctgtctgcatctattgccaccatatttttctatttgagacactctgaggattcaactaagaatccgttgatgctatccagcatttaccaatagattatagtactcttctcttccctttacatctataatctccatccttgtgactgaaagacaggtgagttacagtgtaatgcattttaagagggacaatagaacgttttattttttctcaagttatagtcaaagatagtttctattaaattagtcaatattcttttacatcaggatcttcgcagattcttcctagtattcagtcctagggaaatgtttgtcttttttttttctgaatttgtgtgtatataacccaagtgttttcctttttgcttttatctactaggaagcccagagggaattactaaatttttcccaactaactagtacatttttattttattttattttttgccatgagctgtgttttcattattcacgcaaataattttctataatatcccagggcaaaccagagaatttggcagtctgattggacccatagggaccctcaggctggtggcatcagcacggagtgcccaggttcacgtcacagtttgtggcttgtgtccatcttgtggtgattcttcctccacattactactggggtctcgaagatgacaggggtagggaatcctccaggctcttaggaaatttcacccgcttctcctgctcaatggcctctttggtcagcagggtgttctcctgcatctctgttttcttcagcttggccttattgaagctggcgatttcccctatgtctggtttgtctgccattttcttaaaacaatcctagtgggcaaaccaaggctcttggcctggggctggggaccagtgctcccttccgcattccctgccagtgcctctcaccatggcactcctgctggcagccccaaggcctaggtatttgctcttattaattcgaacaaacaaataaaactttaccctaagtgtatttttatattgggactgctaatccttttttaaaaacaacaaagtataagatacaaaaattatataggaaatgatgaaaagttttggtgatcaaacattatcaaaaagcagtatttgataaatatagttatgaacttaaaaattatgctaagagtctagtaaatagattttcatctgccttattgtttatcacattttatttatttatttaatttttttttttttttttgagacggagtcttgctctgtcacccaggctggagtgcagtggaatgatcttggctcactgcagcctctgtctcctgggttcaagcaattctcctgcctcagcctcctgagtagctgggattacaggtgcctgccatcacgtctggctaatttttgtatttctagtagagatggggtttcaccatgttggccagactggtcttgaactcctgaccccaagtgatctgcccgccgtggcctcccaaagtgctgggattacaggcgtgagccaccacatccggccttgtttatcacatgttagattgcaaaataagcagtaacttctgtcctgagcgtcaatcttaagaatagcggagattttccttaaggaattaactttttacattttatgtattaatttttgagacagggtctcactctgttgcgcaagctggagtgcagtggtgtgatctcagcttactgcaacctctgcctcccaggctcaagcgatcctcccaacttcctgagtagctgggagtgcaggtgtgtgccaccatggcttgctaagttttgtatttttttgtagagatgggtttcactgtgccgcccaggctggtctggaacgcctgagttcaagcaatcctcccaccttgcctctcagagtgctgggattacaggtgtgagccactgtgtccagcctttggtatgaactggcatttattattcattgtacatttcattttagctaagaaatgttggctttatgaatttattatatagagagaatttcatttgaagattatcgatatatggaatttggtggtatatatttaaaagtggttcaaatatatgttgtatatgggtttacatatatgattttttaaaatttgaagggtgtacaccagatggttaacaacaggtattgtttggtggtggagttataggtgattctttcccccttctttttgcttatctgtgttctcatttattttcaatgatgatgaatgtgtaaaaagaaaaagaaaattctggtttctaggagtccacaaggatgttttggctcataaagggccaaaagccaccttctcttctttttaatttaatttttatttttagagctggggtctcactctgttgcctaggctggagtgaagtggtggtgtgatcataactcactgcagccttgaactcatgggctcaagtgatcctccctcctcagcctcccaggtagctgggactgtaggtgtgctgtaccacgcccggctaattattttattttatttttctgtagtgatggtgtcttgctgtgttgtccaggctggtgccaaatttctggcctcaagtgatcctcctactttgacctcctaaagtgctgggattatggcatgcaccatggtgcccggcccaaaagctattttcaatactcacctaccttaaaggaaataatatattaatgaataattacctaaaagtcatacagcatgagatgatgtcaagtttcctttggctttagctagaatgtataacttttctgataatgctgattagtagatgacagctgctttctttgatagtgatatgtctggttgttataaatatatacatttatttatttcagcttaatataagagcaatttaatttagagttcctgttttgttaagcaacaactctttggtctgtactttggaagagtaaccaagtaatgcttggaaatccaagttggaacatagtttcattttacaacatgattaatgttaaatgttaatgctaaaactcactaatttcaggaagttttcattaggacagatggaatgggataaggaacagtctttgagcttctacttgtttgagatactatgctgggtgttcctacactgcctcattttcttttctttctttttttttttttttaatgagacagggtcaccacacactgtcacctgggctggagtgcagtggcacgatcatgactcactgcagcctcgacttcccaggctcaggtgattctcctacctcagcctcccaagtagctgggactacaggcatgtgccaccacacccagctaatttttgtatttttttgtagagacggggttttgccatgttgcccaggctggtctccaacccctgggctcaagcaatcctcctgccttggccttcccaagtgctggaattatagatgtgagccaccacacccagcccctcctgtctaacctaaactttttacactttgaccaactccccattccttgccccttcctccccagcctctggtaatcatcattctgctctgtacttctgtgagttcaactattttagattgcacatgtaaatgagatcatacagtttgtgcctggattgttttttttttttcttttttttttttttaagacagagtctccctttgttgcccaggctggagtgcactggcgcaatcttggctcacttaagcctgtgcctcccaggttcgagcaattctcctgcatcagcctcccgagtacctgggactacaggcatgtgccaccatgcccggctaatttttgaatttttagtagagatggggtttcaccatgttggccaggctggtctcgagttcctggcctcaaatgatcctaccgccttggcctcccaaagtgctgggattacaggcgtgagccaccgtgcctggccctttcatcttttctaatatatgcattcaatgttgtaaatttccttctaagtactgctttcattgcaatggacaaattttgataaggtgtattttcattttcatttagttgaattaaaaaaaattatcttgagctttcttctttgacccatgcattatttcagagtgtgttgattaatctccaaatatttgggagtttttcagctttctgttattgatttctagtttaattccattgtggtctaagaactgaaacattgtatggtttctattcttttaagtgtgttaaggtgtgttttatggcccagaatatggtctatctcagtgaatgttccatgtgagcttgagaggaatgtgtattctgctcttgttggatgaagtagtctctagatgtcaattatatccaactgatgatgttgagttcaactatgtcctcgccgattttctgcctgctagatctgtccatttctgatagaggcttgttgaagtctcctactataatagtggatttatctatttcttttttagttctatcggtttctgcctcacatattttgatgctctcttgttaggcatatacacataaaggattgtcatatcttttttgagtattgacccctttatcattatgtaatgcccggctttatccttgataactttccttgctctcaagtctgctctgtccgaaattagtatagctattcctctattcctgcttttttttgattagtattagcatggactttctccatccctttacttgtagtttatatgtgtctttatatttaaagtttttttttttttttttgtagccaacatacaattggttgttttttttttttttttttttttttttttgagacagagtcttgctctgtcgcccaggccggagtgcagtgagtggcgcgttcttggctcactgcaacctccacctcccatgttcaagtgattcttctgtctcagcctcccaagtagctgtgactacaggcacacatcaccacatctggctaagttttgtatttttagtagagctggggtttcaccatgttggccaggctggtctcggactcctgacctcaggtgatccacccgccttggcctcccaaagtgctgggattacaggcacccagcctaaagtaattcttgatatagttggattaataactactgtatttattgctgttttctgtttgcccttgttttttattcttatttttgttttctacattttctgccctttgtggttttagttgaccatttaatatgattcagttttttctcctttgtaagcatattattcttttttttcccacttttttttagcggttgccctaaaatttgcgatatacatttacaacgaatctaagtctgcttttaagtaacaggaccattcttttcttattttattttatttattattttttttcgagacggagtctcgctctgtcgcccaggctggagtgcagtggcgtgatcttggctcactgcaaactccgcctcccgggttcacatcattctcctgcctcagcctccagagtagctgggactacaggcgcccgccaccatgcccggctgattttttgtattttttagtagagacggggtttcaccgttttagctaggatggtcttgtactcctgacctcgtgatccccccgcctcggcctccaaaagtgctgggattacaggcatgagctaccgtgcctggccattttttttttttttttgagaccgagtctcgctctttcgccaggctggagtgcagtggcatgatctcggctcattgcaacctccgcctcctgggttcaagtgctcctcctgcctcagcctcccaagtagctgggactacaggtgcatgccaccacgcccagctaatttttgtatttttagtagagacggggtttcaccatgttggccaggatggtctcgatctcttgacttcatgatctgcctcggcctcccaaagtgctgggattgcaggcatgagccaccatgcccgccaatgggatcattcttttaaaaatatttttctttttcccattggattaccttgttccctgagttgaaaatcaattgaccaaatatttgtgggtctatttccggactgcctagcctgtttccactgatctaatttgtatatcctatgccaatgtcacacagttttgaataccgttgccttatactatgtcttgaaataagatgatgtaaattctccatctttgttctttttgaagattgttttagctattctaatcttctccattttcaaaaatataaattttagaatcagcatatttctctgaagaccctatgaggattttgatgatcagtttgttggttctgcagattaatttggggagaattgacatcttaagaatattgagtcttccagcttgtgaatatggtgatttatttaggttttcttcaagtatgtattttcgatcatctgtatacgtattttcactccttccaggattacaaaaataacttattcagccaatggaagcaattgctaccagctgagttaagcattcagctatgggttagatatttgagagaacatgggaacctggttatatcttctgtgtgtgacccatccctcagtttattggactgaattcatttgtatagtaataagactatttatttatttatttttttgaggcagggtctcactctgactcccagggtggagtacagtggcacaatcacagcttactgcagcctggatttcccgggctcaggtgattttcccacctcagcctcctgaatagctgagactacaggcatgtaccaccacacctggctaatttttaaattttttgtagagatagagtttcaccatgttgcccaggctggtctcgaacccctgggctcaagtgatccacccacctcggcttcccaaagtgctgggattacaggcatgagccactgtgcccagcctgataagactcattttaatgtaattcacaggtttttgctctttgatgagagtcggtaagtaccttcacttactacctggattacagtgctttatcatctgtgtggattcaacaccccgtatatattttactttcttgtctgtttctttagccactgggctatagtctttaattgatcagtgtctctgatgctgagtgtcccaggctgatcttgaactgctgggctcaagaaatccacccgccttggcctcccaaagtgctaggattacaggcatgagccactgcacccagcctatgaatgtattcttcataggtttactttaagtgccagattaccttcagttatacacatcatcatgttcttattacaggcacatggagtaatggcgggatagatagccttttgccatattaggtttatccatgtacatatttttttatagcacttatattgtgttttgttcatatgcttatttctgactagactggggtcttggaggccaaggacagcctgttatttatctttgctgcagaatgtctggcatattgaggacatgcaggaaaagtttgaattaatgaattatagctcaaaatacacaaggcttctaacaaataattcttgttagacttgactcttgcagttcttacaggttttcccaacacggtcataattcttgtacctcttggcaacatgatgtagcagaagtgggcttcctggaataggcctcagtttgaatcctaactttgctaacctaccaactgttcttttttactcaattaattttaaaaattgagtcaaaatttgcataccataaaactcacccttttaaggtatacaattcaatgatttttagtattttcacaacaaggcgtataaccatcaccactatctaattctaggacactttcattatcccacaaaggaaacttcatacccatattcatgccccttagcagtcactcctcaattccttcttcctccattcccaggcaactaggcatatacaaatcttatcatttttgtttaagggaaacagattaaattgatctggccttataactgacttcttatccttcagaaatctaatatgctaaaaggaggcattaattggtttttctccttgtaggaaacaacaccaaatagggataccatgggacaaacagtgaatgaaggtaagatttacttgttaaaggcaataatgtttttagttactcatttggaatgaatatcttctggtatactgaacttttgaaataaagcctttaaaaaataaatttataggagatgctaggtgcttagaatttgaattttagaactgaatagctattaaaggtcattgtctttccttgctagttatataaatgagaaaactgaaacttagagaggttaaggtcatacaacagtttgtgacaaagccaagattagaatccaaagagtgattaaaaaatgtttcatcctgttttgctctatgagaagtctgctcactattccatgaatatgccacactcatttgcagtcagctttgtgttgtatcttccttcccataatacattctttacatattggccttcctacatcctgtttctccttcaagcgctgtatctctcatgacttttcctctggctgaatgctgagtactaaatgctgttctctaattttaagtgtatcagtttagtgtagtctcttgactagattcttagcttctctagaagctaagcatgcctttacagttttactttgttttcttttagaaaaatccttctgtagaactatttagtaaatacaaatttgtacgttctttgtacagattcaagtttggctttttggtgagagaggagaggataagatgacttcataagtggtgttgtgtatttctcacaggagactcctaatatctagttatctctctctgtctttttttaaatttttatttttatttttttttgagacagggttttgctctgttgtccaggctggagggcagtggcacgatcatggctcattgcaatctctgcctcctgggcttaagtgatcctcttgccttagcctcctgagaggctggggccacagacgtgagctaccacacctggctaattttttgtatttttagtagagacagggttttgccatgttggccaggctgctttcgaactcctgacctcaagtgatcttcccgcctcggcctctcaaagtgctgggattacaggcatgaaccaacgtgcctggcctttttttaaaaaatatttttttacagagatgaaattactcagactagagtgcagtggcgtaatcatagcttactgtaaccccaaactcctgggctcaagtgatcctcctgccttggcctcccaagcaggtgaggctgcagatgtgtgccaccacacctggctaattttttaaaaaaatttttgtggagactgggtcttgctgtgttgctcaggttggcctcaaactcctggcctcaagtgatcctccctccttggcctcccaaagtggtgggattacaggtgtgagctgtcacatccaacctagttatctctttttgtgatgtgaaaaatcacaaaaagtcatggatggctattccctggatccattcatttattagtagttgtaaaatgaaggtattctatcattctttattggccaaaaaatttctatatagagaaactacctttcttcaaccactcagttgaaatcatttaaacagaaagcagctcatatatccctctcaagtgttcacacatcttgaagagtcactcagtcataactagtaagtagatctgttacgttgaatggcatcattcttagatccttctttaagaagtttgtcacttgacaattagaacatcggtaagggtaaaatagcaacacaagtatgtttaaatccatgagttcataatgataataaaaagcaaaacaaataaaacttactggtcatctgtggagaatgctagagatccagctcatcactttgaaaactagaaatacaggaaaataataaagtgctgattgtgatttctctatgtgatccgtgccttaaggtaactgaatggttgaagcatggaagcttctctctatagaagttttctggctaataaagaatgatagaattagaataccttcattttgcaaccattaataaacgaaaggatctaggcaatagccatccacgactgttcacatcacgaaaagagagataactagatattaggagcctcctgtgagaaatacacaacaccacctatgaagtcatcttatcctctcctctcccaccaaaaagccaatcttaaatctgaccaaactcttctggattgaaatatgaatgccaatttaaagaaaatacaagaaacagaggaaccgaactctgtggggaggtagtcagcaaaatccagactggaaaacttgaaaggaccaaccaactggtattgtcagcaaaaaaattgtaaaggggaagaataaaaacgagaagaaaggaggaagacacctgtagatcaaaagagatgtaagagacatatcaaccattgctatgtgtgtggacttatttgggttctgaatcaagcatacacactaaaaatagttaagacaattggggaacactggttatttgatgattttaaggaattatggttaatttttttagatgtaatagaaatattatgcttaagtttttaaaaatgagtccttttagagatacatactataatacatgtggatgaaatgatacatcttagatttggtgaggttaccaggtccagtgttatttgagctctttagcttagcaccaagaaaatctctgcccagtccattgaattacagtgtattgtagcttctctgttatgttttgaactctcaaaagcatctgttttatttctaggacatgttaatttaaacattgtaaagatcagctcattttgatttattgatgcactgatttttttttttttttttttttttttttttttgagacggagtctcgctctgtcacccaggctggagtgcaatggcacgatctcagctcactgcaacctctgcctcccgggttcaagtgattctcttgtctcagctgcccgagtagctgggattacaggtgcccgccaccatgcctggctaattttttctatttttaggagagacagggtttcgcatgttggcctggctggtctcaaactcgtgacctcatgtgatctgcctgccttggcctcctcaagtgctggaattacaggcgtgagccaccacgcctggcctgatgcattgatttaacaaatgcttgagagtgttgcgatgccaggtcctgttttaggcgcttgaggataccacagtgaatgagatagacaataaaataaataaatctctgcccttttggagatttcatttgagtagagtgagacaataaatgagcagattataaaatgcatagtacattagaaaatggtaagtcctacatagaaaatgaagatattataaaactaaaattggctctttaaagttttttaatttatatttttctgagtgctctttcaagctgttgctgtggactcccagtattgctattttcttttttattagattccatggatgtcaagaaggagaatcaagagaaaactcctcagtcaagtacatcttctgtacaaaggggtaggttttaaagtaatttaatacagcatagttttcttcctcactagtgttaaaattaactttaagtgcaaattttcttattgttttgatttcttattgtacagtctgtatactgtaaacttctgtaaatacaaaatgtaataagaaaggtcaaaaattgtattttattttgaaaattttacttagagataagttgacacggattaagtaaaagggtaactttgtatatttcagtgcaaattttcctaaattataggtatctagttattaattgccatgtattaccaatttaaaataatttggttattagcaaaaacccttctaacgttacagtcaatgtgaaagcttttttttcatggtcagaagacagttcagtggttaagagcttataggcattgtggtgagtccgacagatgtgttctggaattctgtcctcactccttactggccatggtgaccttgggcacattactcaacagctcttagacgttttttcttcttctttctttgagacagagtctcgctgtgtcacccaggctggagtgcagtggtgtgatcttggctcactgcaacctccaccttccgggttcaagcgatttttgtgcctcagcctcccgagtagctgggactacaggcatgcaccaccacgcctggctagtttttgtatttttagtagacatggggtttcactgtgctggctaggctggtctcaaacctctgacttcaggtgatccacttgcctcaacctcccaaaatgctgggattacaggcgtgagccactgtgcccggctcttttttcttctttataacacagggataatgatagtacttatctcatggcactactggaaataaatagaggaaatgaatttaaagcacctaatataatgcctaggcatatagtaagtgttcagtaaatgttaactttattaattcatgttccttattatgaacagtacatgtataatattgcatcagagacactcaggagatgtaatagaatctgatgcattggcttgctcttaaatgagaaaataagtcatatgtacacaaaaggcattaaaaaataacgtagcaaactattgttttaccagacatttccagagatttcttgccccttgtgtttctgttgtatctgccctgccagccccagtgcagagcagttcaccctatgaccttctgttcctacttgaagattgcctatagaggtaatccccacggaattgttgttctctcactgtagctgggccctcagtgctcccttaactttctttaccatggccttatttgttcttcaactcttccctgggacccccaaatcctctgaggaaatggaggccattgaattagactgttccttatccctacaaactcctctccatctgtttttaaaaatataacagctttactgagttataattcaaatatcatataattcacctatttagagtgcacaattcaatggttttcagtatgttcacagagttgtgcaaccaccaccacagtcaattttagaacatttttatccccctaaaaagaaatcctgtacccattaacagtactccccatttctccctagtgcctcctgtctcccccagctctaggcaaacacaggtctactttctgcctctatagattttcccattctagacatttaattaaaaaaatagattacttaagttgatagccatctgcagatacttctcaggcctgggccctaacatcctattttagaaatcagtgagtgactaccagaaggtaagctccaagagagccagggttttaatctgttttattaactcatgcatctgcagtacctaggacagtgcctggcacatgctgatgacctgctatgggaatccagttacgaacaatatagacatgattcctgccctcttttattgactgactgattgagacaaggttttactctgtcatgcaggccagagtgcagtggcatgatcatggctcattgcagctttgaccttctggtctcaagtgatcctctcacttcagcctcccgagtatgtgggaccacaggcgtgcactaccatgcctggcaatttttaacaattttttgtagagacggggtctctctgtgtttcccaggctggtattgaactcctgggctcaagcgatctgcccgcctcagcctcccaaagtgctggtattacaggtgtgagccactgcacccagcctcttaccctctttgagcttagtgggcaagatagaaattaacagatgcctaattgtagttgtgataaatgctgtgaattagtggatgctgatcattcagctgagaaacttctatctctaggtattttgcccatcttcacatagcaagggatcccaaggatagcactggtggaagacatgattctgatttactctagagaagaccaggggagctcatatgggttatattcagtacaaaaagatgttggagctaatgtgtagactagaatagagtacaaataaaaaaagaagagaccatgggcacatgtgaataacaatcagatcacaaggagatatatatataaaatcatatcagttcccaggcctctcttctgagatagaatactgcccccatccccagtctgtcaatgaagacatgatgcagaggcagactgggacctcaggcttaactaagactttctgactattttggcttctggttgggaattccaatggtggtattgacgtagatgtgtcaagtctaaattagtaaagcctggagctttgtgtgtttcccctatgttatgaacacgtgggcagccaagatgaacagttttatcaagatgattaagaattttgccttatggaaaaaggggaaaagaaaacaaacaaaaaccaacgaacctgaggctccaaatggcaaatgctgcatatggtcattaaccagtaatttgatagaaaattatattgtagagcactagtataaaggatttgctagctcagattgtagcccattcagacacaaatggtaatagaatattttaaaaatttgtgttatggagatgaattaagtattttctaatattactgaaaaattttacaaatgtcattggtttatggaagagtgttagttctttgggtattcatttcctgcttgttatttctgacttacactattttcctccagggtgtcaacttcttaatgacatccatccatcccaactaaatgttttgttttgttctttttttgttgttgttgttgagacggagtctccccctggttgcccaggctggagtgcagtggcgcgatcttggctcactgcaaccttcgcctccaccttccgggttcaagcgattctcctgcctcagcctcccaagtagctgggaggcacccgccacgatgcccagcaatttttttttttttagtagaaacggggtttcgccatgttggccaggctggtctggaactcctgacctcaggtgatctgcccacctcggcctcccaagtgctgggattacaggagtgagccactgcgcctcgcccgttttgttcttttttaatgctctccaagatcatatggtagtagagcttcacttagaatctgtagtgctagggggcaatcactgaaacatctggtctgtttaattttgaagccgtggatttcggttttcacttttgacaaagctattctgtattaataaatttgagcacaactatgacttctagttttataacgtgccatttattgagtgacttacatatatgctactttatttagctctcaacatatctagtaccatgtacattacttttcccgttttataaatgaaggaactgaggctaagaaagtgaatgacttgctcagggtcacatagctagtaagaggtagagccatactggaagtaggcagatctgactctaaagcccacattcttttttttttttttttttgagatggagtcttgttctgttgcccaggctggagtgcagtggtgcgatcttggctcactgcaacttccacctcccgagttcaagcaattctgctgcctcagcctcccaagtagttgggaattacaggtgcccaccaccacatccggctaatttttgtgtttttagtagagatggtgtttcaccatgttggccaggttggtcttgaactcctgacctcaggtgatctgttcacctcagcctcccaaagtgctgggattacagagccaccgcacctggccctaaagcccacattcttaacactctctctgatgcatgattttcaatgctggtagtgcttgcttcacatcatctggaagtggaatcaaacccagtattttcttttagatgaaacggtctcttagatctattaaccaaaagcaaggtgcaaaatgttacatgtgacatgcttaataccacatataatatgtatacatacatatagaaatgcatacacacatatgtaatggtggtacactggagctggctcacaccggcttgggagagccaattgtgtacatcttttcccaatttcatggttggtggttttaccttggcaccttacagtcaaccatggtggtcatatttacatcacggaaatctgcaaacgctgtcagtcaggttttttgttgtattttccagaaagctggttgttaaacattatcagcactctgtaggtttttttgttttttgttttctgcaaggggggagtcatctaagtataatatcttttgaaggaaatgtaagaagctggtaaacgtagattcttccaggaaagagaactgtcaaacccaatatttttatagtgaggaaatttagcaagagtatagaaaagcctcatgaatgatgagaattaaacatcatgtgaattactagtttgttcactactactgtcaagtctttttctcagtgtcttgacagtctggctggcacagtgaaatgatacgttcaagccaggcaatgtgctctgctttctgatcttctcttctaacattataatatgtcatgaaaactaagtgaggaaggacagcaagagtctgtagaaaatgtaggtcattaaaataatccatattagtgactgtactgatgactggtttattgctttgttctgccaccatcttcttgacactctgaatagagatctaatagtccattgagaaactactctggttaccacatttttttctttccataaagcattgcaagggtaaaattctgtttgactgcacactaaacctttagctccccatgaataacaaagaagtgccttcacattaatggaataaagtggtgaaaacatatttattgaataaatttatattagagacagatgggtagacttcgctattactctaaaacaatttctttagttatttctaacgtccacatttttagaatcactgtgctgtagtccacattacaatgagagtatctaggttataatttatttctgagccattattatcaggatatcgtcttattttttatttttatgctggtcatgaaatgtagatcaggatttttgaatctactcttttggaagttttttttttttttcttttaagaggcatggaactaaaacccattttaatcctgaaagttgtatatactaaaagttacattgtatatgctttaagaaactattttgcacatgtgttttttccagatgatttccactgggaggagtatttgaaagagactgggtctataagtgctccttcagagtgcttccgtcaggtatgccaagattctgtagctgttagttaatgtaaactattaacttgttggaggacgtctgtgtgattgttagattctggtagtgtgaggagatagtgggattgtggtagtgcctcttaagagccagatggtctctttgcattcattaagaacttactctatgtcaggtataataagctttatgattgcccatctggcaggaaaggcagacatataaataaataattatgagaagtgtgataactccatactggaagggctcacaggagcgatgctatttgagatggttggaatgggaggaaggatagtccaggcagagagaacatccaaagccaaggcacatgggcatgaaagaatctgagtattaagggatggcttggggtggctggagcacaaagtggatagaggcgataatgtggaaatgaggttaaaggtgtgggggcatttaaactgtgctgaggagttggacttcattataggcagtggtgagctgctggttggctaatttcaaggggaatggtctaatcagattcttactttagaaagccactcggtatattttagaggctgtatttgggttgcctggaagtgggcagatgagtgagaacagcagcgggtagtgtttttatgctgcatgtcaagccaaggagagaattttgaagatcttttccttgactcttacagctctgacctcactcatcatccactgtgactgttatttaaaatgttcctcaggtattctggtgacatagctgtccatgtgtcttctcttatagttgatgcattttaaccaaattttatttatatatatagtctcagattccacctgtgaatgatttcaaagttggtatgaaattggaagcccgtgaccctcgcaatgccacttcagtatgtattgctacggttattggaattactggggccaggttacggttacgactggatggtagtgacaacagaaatgatttttggaggcttgtcgattccccagacatacaacctgttgggacatgtgaaaaggaaggagacttacttcaacctccactaggtaagaagaaagttttaaaaatagcgtattctttctaatgtgatattcaatagaaatggctttaagtggccttttaaaatttattttcttgggcattcttgcaaatagatggtcaggtggttgctgtggagaatgtatgatgagagaggaaatcagcaccatctgttgtggagttttgcttaagtacatatttggcatatgtgtgtagaagttttctccactccagggcaagactcatgctaggtcttcaaacttgaaatgtcaaaaccagctctactagattacatatgcagattcagaactccttctggggaagaactttgtagcgtttgatacaaggcacatgctctctcaatattgtccactgagccattcagcaattttggtatggggataagcctaggggaagggtatgattccacattcaggttccagtttcaaactcaagaatttcatttcacctacagtgggaagaaatcagagcgagagggacaggaattagtacctttaggtctttgaaaaggagaaaatggagattttagcaaagattttaaggtacaaaatatgtactttaattttggccacatttttgaaaggtaaaaagggtgtaactaatttggggcaacatttttctttttaaaatgtaagcataccatgatactctgtaggaaagaaatgatttagtttatttagttgctgttctatactttgagtgaatggtgggcatttacttttatttggttctttacagtgctgaaaatgaaaattccttgttgcaaagcacaataaaagaatggatttttttgttttcctattagtgaaaaattcctttttcactaatttaagtgaaaatttttcacaaatttaagatattaacaatagccactctttagtaatatatctttatgctgtccttgttctatttgttcgttataactaatttggtttaaaaaatatttttttttgagatggttttcactcttgttgcccaggctggagtgcagtggtgtgatctcggctcactgcaacctccgcctcctggtttcaagcgattctcctgcctcagcctcccgagcagttgggattacaggtgcccgccaccacgcctggctaatttttgtatttttagtagagacggggtctcaccatgttggccaggctggtctcaaactcctgacctcaggtgatcttcccacctcggcctcccaaagtgctgggattacaggcgtgagccactgtgcccggctaaaatatttttaaaaactagttggagatatgttattccaagaagatggtttggggcatgtttgttttttgccttttgccttctttcactcacgtcttttgtcgtttatttgttgtttataatatttctcaaattacacagaattctatgtgaaagataagtgcaatcctaggcttagtgcttccctatttggattttatttctcttgttgcaatatggtatgtttttgcagtttgtttaaaggagatgctgctgttgtaattgtcagcatttcaaatacataactagatttatggtcattctttttaataaaattcttagactttgttttatttaaaaatatgaaatgtatagaaatatgtgctgattagtatctgttttggcagtatatttaaaaatgcaccattggtgccagtttgctttttaggtacttttgaatagtttaacttccattttaatacaacttatttagttttccttttaaaaagatttatttgtttaaactttaaaggttattattaaaagattttataaagttttaacacacaaactgaaaggtgtacaggtcataagtatatagcttataaatgaacacatctgtaaagccatcatccaaatcagaaaatagaacattatcagccccccagaagacctgctcctgctgataaccagccataatctctcctttcctaaaggtactaccatctatacttcctaaccttatagattagttttatctctttttaaagtttttatatgtaccttaatccaattttggtcttttaatctatgtttgactttaagcaattacagaattaagtaaaatgttacatttaggaaaatctgggcacatgatggaataggataatatgggagttgagagagaggcttaaggaccagagaatgattcttatgcaatactctccacagaatggagaataataatgttgatttattataagggagtatgtaacaaatctccccccacccctgtttttttttttttttttttttcaacaattgtgtctctggtcagattaaggggattttggtacaggattattagaggatgactttccatcttaccttttttgtatgttttgttttattgatggaaaataggacaaaacctgcacccattgccaatgattcatgtgcctccctgtcttaatgtatgcatgcatcaggggcgcataccaagttctttctaattctggcattgaggcaagcaggtgttgcatgaaacagattgcccccagaaagcagtaaaactagcagaaccctgctccctgctgcatatgccagatgctgtgaagccattagttggtgagatctctagaaaagacacctgttgagtctattttgatagcatctgatacaaattctaaaagaagatcatttttagtatgtattaagattgctaaagtgagagctgtcttttttctaacacattttatggagaatttcaaacatacagaaaaggtgaaaaaattttacagtgagtacccccatgtccagtttctagtttctaccattatcattttattatatttactttatcacatatctgtctatctatctgcccttctatttattcatcaatccttcttattttttagtacatttcagagtgagttgttggtatcagtgcacgtcccctaaatattttagcatatatatcattaacgagtcaatatctataggtttttttcttttgaggtaaaattgcatgcaatgaaatgtactgttgtgtgtgtatatgtgctgagtttgacagaaaactgtctttctgaagtgaaagaagcctggggccctgaggaaaagggggctagaagtcttttacagcctttgcccttgcttgtgtgattgttggtggtggaatggaagctctcctaggctccagcttagatcaccccttgtattatatacatgtttgtttgtgaattctagctagtgacttctcttaaaaggagagtttctatccccactgtagcattgttgccagacagtacagtggggacactagcaatgagaggagggtacatctgctcctcttgcccatgttcaaagttcttagataagaaagtcattctctcgagaagaatggtgaatgaaacctattttttataccaacttgttaatagtatcacaaggaggctttttcatgatacctaatttattttataaaacagggtaccagatgaatacatcctcctggccgatgttcctcttaaagacactaaatgggtctgaaatggcatctgccacattatttaagaaggtaagaaagatgttataaaaagctgccatgtttttattgttttagtgggaatgcttaaatgcttaatcttctgtgacatggaaaagcaaacatacttttaaaattactggattggcaagtgtattagtttgctagggttgccataacaaagtaccacagactgggtggcttaaacaacagaaatttattttctcagttctgtaggctgtaagtccaagatcaaagtgccctcagatatgtgcaatgctccaccattagcatatagacatgtttgtatctccacaccttcactaacattgaatattattcatcttttaaaatgttgggaatcttttttgtgggggagtggtgaagatgaggatggtatcccattggtttctggtgagatctctcttcttggcttccagatggttgctttcttgctgtgtcttcacatggccttttctctatccatgcacatccctagtgtgtcttcctcttcttatagggacaccagtcctattggattagaggccgacccttatgacctcacttaacctttattacttccttaaaggccctatttccaaatacatatatgttgggggttggtgcttcagcatatgaattttgagatgatacaattaaattcgtaacaatagcttaaataatagaaatatattttctcacagttgcggaggctagaagtctgagatcaaggtgtcagcaggtttttttttttttgttttttttttttgagacagagtctcacctgtcacccaggctggagtacagtggcacgattttggctcactgcaacctctgcctcccaggttcaagcaattctgccttagcctcccaagtagctgggactacaggcgtgcaccatcatgcccagatactttttttgtatttttagtgaggtggggtttcaccatattggccaggctggtcttgaactcctttttctttttttttgagactgagttttgctctgtcacccaggctggagcgcagtggtgtgatctcggcttcccgggttaaagcaattctcatgcctcagcctcctgagtagctgggattacaggcgcgtgccactacaccaggctaatttttgtgtttttagtagagacggggtctcgccatgttgtcctggctggtcttgaactcctgggctcaggtaatctgccagccttggcctcccagagtgctgggattgcaggcatgaaccactgcccctggccaggtttggtttcttttgaggcctctccttggcttatagatggctgccttttccctgtgttttcacgtggtctgtttattcgtgtccaatttgttcctcttataaggatgtcagtcatattggattagggcctaccctaataaccttattttaacttaattacctctttgaagaccctgtgtccaaataccatcacattctgaggtactgggggttagtgcttcaacatacaaattttgggggtgacacaattcagcccagaacagcaagtcataaaaaagtctcaattacaataacccactggtccaatttcattagcagcctctttcttgactgtagatataaaaagagtgctctactggaagcaaatattcattgctattttttatttgcattcagaagtgaagcttcccctcactttactgtgttagtccctttgatattggagaaaaagatgatgggccaaaaaatcactcgaaagttagttggagagatttggtttcagaagtaatgttaaaagcagtcatcagaaagaatttgttatgaggaaatacttggtatataaaaaaagaggaaaaatttccaaagtagtttatgttcttgagaaaatgttgaagagtatgttaagaaacaataaaagccacgttttagttaaattatgagtcagaatatttctttctcaccttttctcctgattgtttttcaatcacttaacttttattacaactatacttggaatggtaagaattgattgttgttttaaaaagcttttgaagaagattgaaggcataaggatgtgaaacatcaattactatgcctccattgcaaagaaaaattctgtgggtacgcctctgagtaagatgaatgcagaaagtggacttgccctacctgcaagggacacaggcagcacaggccctttggccagtggtaagccatgtgtgagaatagccaattaaaaaatatttagcagaagtctttatttattgaacacctattagcttgggctgtggctttagaaaagccattggatctgttttactagtcagattgcttaatcagcatgccacacttgtcatacacattatattttcaatttttttaattataaaagtaattcatgtggtggggggcaggggatgggaatcaagctatactcttagctagagtgaaaaatgcatctccctttgtcccaaccattccttcattcctctcttccctccaaattgaagttttatttgttctcccagacctttttcttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcctgctaccacgcccggctaattttttgtatttttttagtagagacggggtgtcaccgtgttagccaggatggtctcgatctcctgacctcgtgatccgcccgcctcggcctcccaaagtgctgggattacaggcgtgagccaccgcgcccggcctttctttacatttacaaacaaatatgggcttttattttcttaaacatcagttggaatatattgtacatattattctgtggtttactttttctcctaacagttttggaaatcattctatttcatttcatatatattttagcttgtattgtactcttgtgtagtatggatcatcagaattcatttaaccctagaattgacttaactgtaaggatggatgattgggtcatctccacattcttgtttagatcagctctatagtgagcattcttttaaagagctttgtgtataaacgtgaacggttgcattcttggaactagaattgcttgttcaaagggatgtatgttttggctgggcatggtggctcacactttgggaggccaaggcaggaggatcatttgagcccaggagttaaaaaccagcctgggcaacacagggagaccctgcctgaaaaaaaattttaaaaattataaagaaaaaacaaaggggtgtatgttttaaatgttgatatatactgtgaaattgcatccccaaagggtattctaaggcagcagtccccaacctttttgtcaccaggggtcagtttcgtggaagacaattttcccatggatggaggggtgggtggtttcgggatgattcaaacgcattgcgtttatcattagattctcctaaggagtgtgcaatgtagattcctcgcatgtgcagttcacaatagggtttgcactcgtatgagaatctaatgcctctcttgataggagacagagctgaggtggtaatgcgagtgatggggagcagctgtaaatacagatggagatttgcttgcttgcctgctgctcacctcctgctgtgccacccagttcctaacaggccacaggccagtaccagtctggggggttggggacccctgttctaagctatgctccaccattagcccataaacatgtttgtatctccacaccttcactaacattgaatattatccattttaaattttcatgactctttttttggagggagtggtgaagatgaggatggtatcccattgttttaatttgcattgcactgattactagtgaaattgtgcttttaagatttgtttaatggccttttgtttttctgtgaattgtctgattatagcctttgcctatttttctgttttgtttttgagacagagtctcactctgtctcccaggctgcagtgcagtggcgtgacctcagctcactgcaacctccgcctcccgggttcaactgattcctgtgcctcagcctcccgagtagctgggattacaggcatgtgccaccacacccagttaatgtttgtgtttttagtagagacagggtttcaccatgttggccaggctggtctcgaattcctgacctcaggtgatctgcctgccttggcctcccaaagtgctgggattacaggcgtgaatcactgtgcttggccctttgactgtttttctattggatttcttttcttcttagaatcatcatcttaaatcctcacttttccttgattttggcctctggaggtccactcacttaggttcctaattatttatttgtcctgtttctttctaaccttaccaccactgctccttgggcagactgtcaacctaaaataacagcagagaaataggctctccaaaaaaaaaaaaatagtctatttgggaacgaatgacaagggattacaatgcaggatgtttgtgctgtgatggatcattggcatatctggtgaaggtaaggcaaagggaagcttttaaaggcaaaacaaggaaggttacataagttgttttgaaacacttatccttggccacaaggatcaataacaagagtggtatctggggttgaacggttactggatagatgtccttgcaggagtattctttgtgtgaggttgtggttttcagagagtccttgtaatagtttttatcataggcgtgtgtacatgagagcccctcctctatggtccattttgttagggtttggcataagtgactccattttgattctgacaacttttataaggctctcctcttgcctgaactgttatgctagccttttaactgcctctaatcttcaccctttcacacagccgctagaaatgtgtatcttatacaaaaaccttaccatgttattcccctgtttaaaactcttttgaaattcctggttatactcaggaagaagtataagtttttcaatatggcctgttaggtcctgtgtgatcaaatttagggatgccactccctgctttggatgttatgttcttaaattgcttgtgaaagcttgtagatacctgtttatttttagagctctgttttgactcatgttggtttttcctggttagctcctactttttaaagattcaagtcagatgttaaatcctccaagataatatccctaattccccttctccattcttctacttttttttttttttttttttttttttggtgagacagagtctccctctgttgcctaggctggagtgcagtggtacaatttcacttcactgccgcctgcaacctctgccccctgggcttaagtgattctcctgcctcagcctcccaagtagctgggactacaggcacctgccaccacgcccggctaattttttttgtagttttagtagagacggggtttcgccatgttggccagtctggtctcgaacccccaacctcaaatgatccacccaccttggcctcccaaagtgctgggattacaggtgtgagccactgtgtccggcccattcctatacttctatagcattgtatatatcccaatctttgtatgtgttagattatattattatttttactgtctctcttcctggactgtgagttccttttgagcagttagcatgtttttgtattgtcagtgcctatattagtttctggacacatacttgtttgttaaaagaatgaagaaaggataaaagaatacaggaagataaatatttatggaaggaacagatgggcttagttttgaacgtgttgaggtgtctctgggaaatttgagtagtgatgactatcaggctgttgaaagtaaatggtttagaacttaggaacaaagtttggcttgggcacatggatttggaaatttttagcagaaatagtagtgatagaagctttgagcttaaatgagctagtccagagaatatatagaaggaagagagaggagtgtcaaggtgagagccttgagaaatacctacctaccttatagggtgggtaaagggataggagcagctctagaaatggaggaggaaaactagaataagccagtgtcattgaatccagtggggcagagttgcaaggattagggagtggttaacagtctcaagtacagcttagaattacacagtgcctggcccatatcatgtacttaaggaaggtcatttatgaggaaagctgatttttgactatttggtagatagaaaatcatcagttacattagcaagagctaaagtccaggtgaaaagtgtcctcagctaaatttataattttgggcagactatatggagatcattcctgatggcttcaatttactatttctataaatagacctcaatgatgggaagatcacttgagtctgggaggttgaggctgccatgagccatgatctcgctactgcatgctaaccttttagcctaggtgacagagtgagaccctgatttaaaacaaaacaaaacaacaacaacaaaaaaacaaaacctcaaattcctatttctgcaaagtaggaaactggcaaaggctggaagaaaattcatacatactggttggggataaagtcagttaacaaaataacaaacatatagtgaggctacatcatttatctcaaggagaatggttaaggtttggaacagctgccatacgggatgggagagggaatggtctagggacacatgacagtattttggagggcttagctaaggatgaagggtaaaaatgtgtgtcactacatgtaataagcatgtgggagggactttgctgcagcagtgctcagcagctgtattagtctgttttcatgctgctgataaagacatgcctaagactggggagaaaaaagtttaattggacttacagttccacatggttggggaggcctcaggatcatggtgggaggtgaaaggcacttcttacatggtggcggcaagagaaaatgaggaagacgcaaaagtggaaacccctgataaactcatcagatcttgtgagacgtattcactaccacgagaatagcatgggaaagaccggcttccatgattcaattacctcccccgggtccctcccacaacaagtgggaattctgggagatacaattcaagttgagatttggttggggacacagccaaaccatagcagcagctaagtataaataggtgaagtggatggtgatattgaactaaggtttggaataacagggcaaagacaagggaataagttggttttggatgctgagaagagagtagtgaaatgatgctttgtaacctagatatgagtgctgcttcacatcctacaatgcacagaatacacatacacacacacacgcgcacacacacacacacacacacacacacacgcacacccattctggctccaaacgtcagtagtgccaaggctgagaaaccctaacctgtattaatcccctggtgagctcatctaattatctggctttaaatacagtttatatgcaaatgattttcaaatttgtatttctaccccagacctcttactcccaactcagatttgtatatccagctacctactctacatctccacttggatgtctgatggacatctcaaacagttccacctgttaacctccctatctcagggaggggaaactatctttctagttgctcaggcctcaaaccttggtaattgtttctttcacaccctacatctggtccataaggaaatcctattgactgtaccttcaaaatacagtcagctttccatatcctcgggttctgcatctatgggttcaaccaactgcagattgaaaatattaaaaaaaaacaaacccaaaatacagtaaaaaatagtacaagtgaaaaaaatatagtataacagctatttacataccatttatattctattaggtatcataagtaatctagagattacttaaattacttataatctagagattatttaaaatatatggggggatgtatataggctatatgcaaatactgtgccattttatatcagggacttgagtgtccttggattttggtatcttcagtggatcctggaaccagtcctctgtggattctgagggacaaatgtatatccaaaatccaaccacttcttgccgtctccattgttaacactctggtacaagctgtctttttcaatctcagttggattactgcagtagcttctcactggtctctgcatttataactttacaggctatcatcagcacagcaaccagagtattccttttaaaatgtaaatcacagccgggcatggtgcctcacgcctgtaatcccagcacattgggaggctgagatgggtggatcacttgaggtcaggagttcaagaccagcctggccaacagggtgaaaccctgtctctactacaaattgaaaaattagctgggcattgtggttgcgcacctgtaatcccagctactcgggtggctgaaacaggagaattgcttgaacccgggaagcagggattgcagtgagctgagattgcgacactacactccagtctgggcaacaagagtgagactccgtctcaaaaacaaaaacaaaacaaacaaaaaacccacataagtcaaattatatcactcctctgttcaaactcttccaggggcttcctgttttactcagagtaaaagccagaatccttacagtgatctataaaactatatatgatatgacccctcattatctgtctgacctcatttcctactgctctcctacttacattttacccacactcaacttccttggtgttctttgaacatttcagacacagctcctgctttagggccttggttctgtccatttccctccttcagatttctgctcacatgtcaccttctatatgagacttgttttaatttctctatttaaagttgtacaacccctcctacatttctctctggatttttcctattgtgctgttctctctctctctctctctgcatagcatttatcatttctaatgtatgtgttttactttttaaattatgtttattgtctctcctcactagcatgtaagtgctgtgagggagggattttgtcttttttgcttgttaatatatcccaagaaccttcagtagtgtccggaatatagtagatactaagtaaatatttgtaaatgaataaatgaaggttaaaggactaaaattattggtgaggtcaaataagtagttgattaaaaataaggagatagaagttcatgtattagtttgtggtcagaggcaggtactgggaatatagcagtaaacaaagcataaaatatgctcttatggagcttactttctacttggggaaatgtttaatagatatgctaaataaagaaagtgtatcttatgttttatactctcacatgtttagaagagaggtcgacattttagacaggttggccaggagggtctgagaaggtaccttttgagtaaagatctgaaggaaggcagacagtgaaccatgaggctacaagagtaggattattccccaggcagaggagtaatgcagagaatgctgagactggtttcggattttgtgggacatgggaagaaatagcctttaaggagaaccatattgtaggtaatcaagaagggaggttaaaagctggatgtggtggcacgttcctgtagtctcagctacttggaaggctgaggcaggaggactgcttgagcccaggagatttgagtccagcctgggcaacatagtgaggagaccctgtcttttataaaagtaaaagtaaaataaaataaaatagaaatgaaaaaaaataaataaaataaatataaaggctgggcgcagtggctcacacctgtaatcccagcactttgggaggccgaggtgggtggatcacctgaggtcaggagttcgagaccggcctggccaacatggcaaaaccctatctctactaaaaatacaaaaattagccacgtgtggtggcacgcgcctgtaatcccagctactcgggaggctgaggcaggagaattgcttgaacccaggaggtggaggttgcagtgagccgaggtcgtgccactgcactccagcctgggcaacagagagagaccgtctcaaaaaaaaaaaaaaaaaaaaaaaaagggaggtggttaaaagagcattctttgctagccatcttctagaatagaaccatttttgtctcaccgtaaaagagaattccttgtttattttagctattgcttttgcaaattatatttttgtgttcaggaagttattaaagaaccgatgatgatgacaaaccaaattctttaaaagcatttcacttaacataatgacctccagttctatccatgttgctgcattgacaggatttcatttttatagttaaataatattccactgtgtatatatatcacattttctttattcacctgttgatggacacttgattttttttgttttctctccaacttttattttaggtacatggggtacgtgtgcaggtttgtaatacggatagattatgtgctggggggctttggggcacagattattttatcacccaggtaataagcatagtagccgataggtagttttttgatcctcaccctcctcctaccttccaccctcaactcaagtaggccctggtgtttgttgttcacctctttgtgtccatgtgtactcactgtttagctcccacttgtaagtgagaacatgcagcatttggtttatctgttcctttagggtaatggcctccagctctccatctgtgttacagaggacatgatctcgtccttttttatggctgcatagtattccatggtatatatgtaccaaattttctttatgcagcccaccattgatggacatcaaggttgattccacatctttgccattataaatagtgctgcaatgaacatacgcgaacatgtgtctatggtagaacaattcattttcctttgggtatatacccagtaatgggattgctgggtcgaatggtaattctgttataagttctttgagaaatctccaaactgccttcctcagtggctgaactaatttacattccaaccagtagtgtataagtattttcttttctctgcaacctcaccaggatctgctgttttttgactttttaataatggccattctgactggtgtgagatggtatctcattgtgggttttttttttttttttttgagacagagtctcattctgtctccaaggctgaagtgcagtggcccaatctcggctcactgcatcctctgtctcccgggttcaagagattctcatgcctcagcctctcaagtagctgggactagccaccatgcctggcaaattttttgtattattcgtagagacagggttttgccatgttgaccaggctggtcttgaactcctgacctcaggatatccacccacctcagcctcccaaagtgctgggattacaggcatgagccactgcaccaggccatctcattgtggttttgatttgcatttctctaatgattagtgatactgagcatttttttcatacgcttgttagccacttgtatgtcttcttttgagaagtatctgttcatggatggacacttttgattccatatctggctattgtgaatagtgttgcagtaaacatgggagtgcagatatctcttcaatatactgatttcctttcttttggttatgtacccccagaagtgggattgctgggtcatttggtagttttatttttttctctatgctttctcaccaacatttgttatttttttggtctttttgataatagtcattctaaccggggtgagatggcatctcattgtggttttgatttgcatctcttggccatttctgtgtcttcttttgagaaatgtctattcaggtcttttgcccattttaaaatcaggttatttgttttttgctattgagttgtttgagttccctatatattctagttattaatctcttgtgatggatagtttgccagtattttctttctccctttctgtaggttgtccttccctccctccctccctccctccctgtcctttcctccctccctgtccttccctccctcccttccttcctccctcccttcctcccttccttccttcctgtttttttttgtttttttttttttgagatagcatctcactccgttgcccaggctggagtgcagtggcaccatcttggctcactccaacctccacctcccaggctcaagcagatcctcctgcctcagccccctgagtagctgggactacaggcatgcaccaccacacccagctaattttttttttttcttttgagacgagtcttgatctgtcacccaggctggagtgcaatggcatgatcttggctcaccgcaacctccgcctcctggattcaagcgattctcctgcctcagcctactgagtagctgggattacaggcatgcaccaccacacctggctaatttttgtatttttagtagagacggggttccaccatgttggttaggctggtctcaacctcctgacctcatgatccacccacctcagcctcccaaagttctgggattacaggtgtgagccaatttttatacttttttagagatagggttttgctaagttgcccaggtggtctctaactcctgggctcaaatgatctgcccacctcggcattccaaagtgctgggattacaggcatgagccaccatgcctggcctaggttacatatttgaatcttaaaattagttctattgcattgcttattccagttttttaattgttttgttgcagaaaatatacattgccatttgaacttagtttgctttgctacagaaagtctcagtctgttataagacagtgtaaggtcctgggatccttatgtgtgccttgaatgttttctgcattctgtgagcatctagcacaaacttgtcaactgccgtgtttattctttgttaaatgcagcttacctccccactattttcttctcatacatagtaacaggcagttaacctttagccctttcatgtaacactgcttcttacttaccagctatttatcaaatactttgatctttaatcatctaccttttgacttgccagctttcagggtggattttttttttttgaggcagagtctcactctgttgcccaggctggagtgcagtggcaagaacacggctcgccgcggcctggatgacttccggggctcaagtgattctcctgccccagcccactaagtagctgggactacaggtgtgctgccaccatgcccagctaatttttgtattttttgcagagacgaggtttcgtcttgttgcccaggctgttgtcaaactcctgagctcaagcaatccacctgccttggcctcccaaagtgctgaattagggattacaggtttgagcccagggtggtttttaagaatcaaattaagatatgtaattcagcctggcatggtagctcacacctgtaatcccagcagtttgagaggctgaggtgggaggattactttaggccaggagttcgagaccagcccggccaacatagcgaggccctcatctctataaaaataaaaattaaaaaaagaatatgtaattaaaaggactttggaagctaataattaaggagcttccagatcgtaagggtgtaaagagtaacaatagaaaaatacagggtgatgagatgggttttaaggggggcatttgaaaaagaaaccaacctaccagatatattttttaaattgatgagagaattagttgagagcttatttactgttttggggtgattccttggttctctcatttaaaaaattgcttgcttttggttattgtgctggaaataataatatgaatagctgtttttaataatctcttagtctcatagaggaatgaacacatttctatagtgatactacaattgaagatgagagtggctcagttggaactgggcctaggagtgggcaggggttggtcagggaagcattcaaggaagctaggagaactgggctttaaactgggtgaattggagttgtccaggcagatgctggggtagggtgctccaaggaggtgactccgagacagactgcctaggtttaaaatccagctctgattgggaggttgtggtttttaattgaattatgggtaagtgaaagggatgaatctagggtagtggttctcaacctcaagtgcaccttagaatttccctgataattaaaatattgctgcttcccaggacccaccatagatcaattattagctctggtggtgtggtcacaggtgattgtaatgttcattagggcagaaaatcaccagtccaggactacttttttttaaattcttttcttttctcttttaatttgaacaagtgtcagtagaataggattactatttccagtcttttggcttaggtgactgggttgctgtgatggtgccatttagtaggatgaaaagcagattgaaagaaaagatgttgcttttaacataacacttgggctttttagcaatcctgttaacatttacgtgctttaacctttttgtgactaatacttttaaaatgttgatttctggattgggtattataaatgaccccatactatatgactttcatgttcttgtgtctgtattttatacttacagtttcttttttttttttaaattttaagttattcattttctttagaattcttatactttgagtttcttttaggatattatctgatgtcgtttcttttctttggacttaccactttttgacacaccaatttacatatttgttaggtttgtttgactgcctgttgtaaaatttcttgttgattgcttttccctgtccgcaaccactactatcaccagcattagaatgtaagctccaccagagcagggatgtttgatatatttgttcatcaatgaatcttaaattcctggtacatagtagataatacatatttcttgaatgaatgaacccggctggttttgtttctttccaggttcttgactctgctccagagaaaatatgagatgttggagagcagagtttcagatctgtgagaactgttgtcttcctgtattaattgataattaaacatggagcttaatttttggttgctaagggttgtgagagaatacgcaacttttcacttcgagcacatgagtcttaatacatcttaacaatgaaatcttttttttttttaatgttttgataggaaccaccaaagcccccactaaataattttaaagtggggatgaaactggaagctattgacaaaaagaacccgtatctcatctgtcctgcgaccattggagatgttaaaggggatgaagttcatatcacatttgatggctggagtggagcttttgattactggtgcaagtatgattctcgagatattttcccagctgggtggtgtcgcctgacaggagatgtattacaacccccaggaactagtggtaagataataattaactactttttcttctactttattgaagttagatgtaactgtcattggtggcattgtgattagcgttggtggtaccaggtggtacatgccccaactggtggcagacagaacaaagcgctgtccaggctagagaactggaggtaaaggaaagctatgattagaattcttgaggtcactgcagcatcatagtctgagttccagtccacactggagattatggacaaagctaaaagtcatatttggaccattgaggtcttgttgctataagcaaggggggtggtatgtactcagctccttttatagttgatattcaattaaaaattatacatggtattccattgttcatatctcaaagatattttttaaaagactgggcttaacaactgttataaacatgtcttacatgatttttgtcctgtttttaagttaaattgacactttgatagccttaagttaaatctacagtgaaaatttttgactctgtggaagccatcataaattagtatgctattttagtcatggtaatgtttattagttgtaacggtgtttcctaagctgagtactatgatcttctagatattttctttcagagaaaagctgtcaacatgttgatgttccttggtgactctttcaagggcttagatatgcctaacctggtcttctatgatggagtaactgctgaggcttaagtggggtctaagcatagaacccaatcattggcctaagttaatataaacttagtgggattcaattagccgggcgcggtggcgtgtgcctggaatcctagctactcaggaggctgaggcaggagaatagcttgaacctagagggtggaggttgcagtgagctgagatcgcgccactgcactcctgcctgggcaacgagaacaaaactccgtctcaaaaaaataaataaatgaaaaatcaacttagtgggattgaatataaacatacttaaaaaactaacgctactaagtatatttatttttatgagaaaaaaagatagatgtagaaaataagtacgcaaagtgtgcagaggagtataatgtctaggtaagagcttatagccatattattcttgcaatggctgttagaatcatctgtaattcgggactttaacacattccattatactacagtactgtataccacagtgtcctttttattaggtacatctttaaccagtttcctgcttccataagtctaggaagtagatattaatggttgattttgtaaaatttagtatgatacagatctgtgtgtatatgatattaagataaataaaacatagtctctaccctcaagaagtttaccttctaatggaagagggatgcatggaggcatagatttgtaaaaagaagatatagtattagcaatgcaaaaatagagatgtatgctagatgtggaggtggcccaaagtcttccagtcttggctggagggaaaggtggttgcataaaggaaagcatcacaaaaggtgcatgatgtgagtattagatgagaagcaggagtttgccaggcagaatggagataaaagtaggatggatacataacaaaagtgcaaaattccagtttatcctaaaaactgacgagttcactttggaacacagtgggtttggaacgtgtggctgagaatgctgttgtcctccagtatttcttctctctttttttcttagtattacaattggctgcctaacatacagactcctagcagtatggtatggccacgagactaagtcctgattgatggaataaaagtacacatagtgtgtactttctccagaaagtatattatagagagatgagcatgtcctttccttttccttctttctgcttttatcctgctgttacgaatgtggttttgactggagctccatcttggagcatgagatggggaccatatgctaggcactgtggagtgggtggaaagcagccaggagccagagtccctgagaacttggtggagcagagctttcatactagcccatattatctgttttcagacaattgtgagaaataaacttctatgttatataagtcactgttcttttaggtttttctattactgctagctgaactcaatcctaactgattcagggtaactttgggacatccaggtgcacatgttcattggatagctgcacatgcagatctggagcctaaaaaagataggtcttgttgacaaagcaggtttgagagtcatcatgttccctcagataaatattctttgtgccaggtgggattataggtgcttgggatgggagggtgagcagtttacttattttgttgatagcagcaagtggtggaagttttgagtgtgttttaattgtgtgtgtataacaagtagaggtagaaaaggaccaggacagaaccttgtgggtcgacatttaaagcagtaattatcactcttgaattgcctgggggagcttgttaaaagggagtgctcgggaactcacatccaggggtttgaatccgtgggttcgaagtggggctcagttgtttccagtgcacatggtttgaagcctgaactttgagaagcacaaaaataaggaataggtagtagaagtcaatctaggacactggaaaaaagtatacgtaaatgtaggagatcactaggttggcttccatggcaacaggagagaaaagattttaaggagaaagtactcaacattatcaaaggcagtgtaaaagtcaagcaagaggagaactcgttagcggtcttagtaaaactgtggttactcggcttctttaaaaagctagatttagagagtcaaggagtaaataggaaatgtacagtgttaaaaagaaaaaaaaaagaaaaagaaaaagtggtttcccaatactttgtgagatctgcttcctctgtctttaccccagttgacattcactttgagtgaactttagaaatcttacctcactttatgtccctttaccctctattatatataattgtcttcaatattgagaaccacattagtattataatttttgcttccaccatcaaacataacttagaaaactcaagagaaggaaagtctgttgtatttatttacatttttaccctttaaattgttcttaattcctgattttcaagatttccttattttatcattttcttcctgtttagagaacttcttttaaccattcttttagggttgggtggcaacaaattctctgttttttggagacagagtttcgccgtgacacccaggctggagtgcagtggtgcaatcatggctcactgcagcttcaactctccaggtgcaagcaattgatcctcttgcctcagcctcgccagtagctgggactacaggcacgtgttaccatcccaggctaattttttaaatttttggtagagacggggtctaactgtattgtccgggctggtcttgaactattggactcaagtgattctccctcttcagcctctcaaagtgttgggattataggcatgagccaccacacctagccctcctcttcattcttgaaggatagttgctggacatggaattctaggttgataattcctttcatttttttcttttttgatttttttttttcctgagacggagtctcgctctgtcacccagcctggagagcagtggtgtgatcttggctcagtgcaacctctgcctcctgggttcaagtcattctcctgcctcagcctcctgagtagctaggactacaggtgcccaccatcacgctcagttaatttttgtaattttagtaaagacggggtttcaccatattggtcaggctggtctcgaactcctgaccttaggtgaaccacctgcctcggcctcccaacgtgctaggattacaggtgtgagccaccttgcctggccaataattcttttcttttcacacttgaaaagtattctgcaacttccatctggcttctgtggtttctgatgagaaatctactgttattcagattttttttcccttacagacttcatataattatggatttgttttttcttgtatttctttcagtgtttgctttctgctttatctattttgtggctgtattatcaagtgtgtaccagttttgaattattataatttcctggtgaactgaaccttccacggtaacctgatttatttatggtttttctccttttgctggggaaaccaacctaatgattttttttttctttttttttttttgaaacggagtcttgctccattgcccaggctggagtgcagtggtgtgaacttggatcactacaacctctgtctcctgggttcaattgattttcctgcctcagccttctgagtagctgggattataggcgtctgccacaacacccggctaatttttgtatttttattagagacagggtttcgccatgttggccaggctggtcttgaactcctgacctcaggtgatccacctgccttggcctcccaaagtgctgggattacaggtgtgagctaccatgcctggccgatctttttttttttaaccttaacgtctgctttatctgatgaccagattttgtgtggatgatgtttttgttatctttttctgactaaggctcaaactttttttttttttgagacagggtctcactttgtcacccaggctggagtgcagtggtgtgatcttggctcagtaaagccttgacttcctgggctcaagtgatcctcctgtctcagctccccaagtagctgggactacaggtgcgcaccatcacacctggctaatttttgtatttttagtagagaccgggtttcaccatgttacccaggctggtctcgacctcctagtctcaagtgatctgcctgcctcggtctcccaaagtgctgggattacaagcgtgagccaccacgcctggccaagaagttgccatactgtttttcataatggctatactaatttacattcccaccaacagtgtataagagttcccttttctggccaggcatagtggcttaccctataatctctacactttgggaggccgaggtgggaggattgcttgaagccaggagtttgagaccagcctgggcaacacagtgagactctgtctctacaaaaaaataaaaaggtaaaatgggcatggtgatacgtgcctatagtcctagctgctggggaggctgaggtggaaggattgcttgagccctggggctaagagatcccagtgagctatattcatgtcactgcactacagcctgggcaacaaagcgagaccttgtctctatttaaaaaaaaaaaaaaaagagttcccttttctctgcatcctagccagcatctttttttttgtctttttaatagtagccattctaactggagtaagatgataactcattgtggttttgatttccatttctctgatgattagtgatgttgagcattttttcatatacttgttggccatttgtatgtattgttttgagaagtgtctattcagatcctttgtccactttttttttttttgagacggagtctcactcagttgcccaggctggagtgcagtggcgcgatctcagctcactgcaacctctgcctcccaggttcaagcagttctcctgcctcagcctctcgagtagttggtactacaggcgtgtgccactatgcctggctaatttttttttttttatttttagtagagatgggatttcaccgtattagccagtatggtctcgatctcctgacctcgtgatccgcccaccttggcctcccaaagtgctgggaatacaggcgtgagccaccttgcccagcccctttgtccactttttaattaagggattattagttttttcttgctgttgagttccttgtatattctggttattagtcccttgtgggataaatagtttacaaatattttctcctattcaagggttgtctccactctgttgattgtttcctttgcagtgcataagctttttagttttatgtagtcccacttgtctgtttttgtttttgtggcctgtgcttttgaggtcttagccataaaatctttgcttagaccaatgtgctgaactgtttctcctatgtttccttctagtagtttcatagttttatagtttcgggccttatgtttaagtctttaatgcattttgagttgttttttgtatatggtgagagagaggggtctaggggactagtttctttttttttttcttttttgtgagacacagtctcactctgtcacctaggctggagtgcagtgcaatcttggtgcactgcaacctctgcctcctgggttcaagcagttcttctacctcagcctcccgagcagctgggttacccatcagttagagacggggtttccccatgttggccagtctggtctcgaactcctgacctcaggtgatctgcctgccttggcctcccaaagtgctggggttacaggcatgagccaccacgcctggcctagtttcattcttttacatatggatatccagttttcctagcactgtttattgaaaacggtgtccgtgtcccaatgtacgttcttggcgcctttgtcaaaaatcagttagctgtaaatagatgggcttatttctgggttttctgttttataggtcaatgtatttgtttttatattaataccatgctgttttggttactatagccttgcaatgtattttgaagtcaggtggtgtgatactgctctcttttttttgctcaggattactttggctatatgggctctttttggtttcatataaaatttaggattgttttttctatttctgtgaagagtgacattggtattttgataaagattgcattgaatctgtagcttgttttgggtagtgtgttcattttaacaatattaattcttctgatccataagcatgggatgtctttccatttgttcatgtcctcattagtttttttcatcagcgttttgtagtttttcttgtagagatctttcacctccttggtaaaatttcttcctaagtgttttctttcttcttcttctctcttttttttgagactggttcttgctctgtcacccagggtggagtgcagtggcatgatcacggctcaatacagcttccacctcctgggctcaaacaatcctcccacctcagccttctgagtagctgggactacaggcatgtgtcaccatgcccagctaattaaaaaaatgttttttgttttgttttgttttttgtgtttttttttgtagagacagggtctcactgtgttgcccaggctcctggactcaagtgatcctcctgcctcagcctcccaaagtgttgggattacaggtgtgagccaccacacccagtgttttatttcttatgtggttattataagtggaattttcttaatttcttttacagctatttcattattggtgtatagaaacactactgatttttgtgtgttgattttgtatcttgcaactgtactgaatttgtttattagatctaagaattttttggtggagtccttaggtttttctaaatacaagatcatgtcacctgcaaagagggacaatttagtggttagaaagtcgtgtgaggaagtaaccacttgagccaaagccagcccacgaggcacaatttgccttccttttttccatttagattccttttatctctcttgcctaattgctctggctaggacttccaatactatgttgaataggagtgctgaaagtgggcattcttgacttgttgcagttcttagaggaaaggctttcagcttttattcagaatgatgttagctgtggttttgtcatatgtagcctttattatgttgagtagtgttccttctgtgcctagtttgttgagagtttttaatcatgaaggacgttagattttatcaaatgctttttctgcatctgttgagatgtatggtttttgtccttcatactgttgatatgatgtatcacatttatttgtgtatgttgaacttatcgttgcatccttgggacaaatcctacttgatcttggtgtattatgtttggattcagtttactagtgttttgttgaggatttttgcatctatgttcgtagggaaattgacctgtagttttctttttttttccttgtgtccttgtctggttttggtattagggtaatgctggccttgtagaatgagttaaggagaattctcacctcttcaattttttgaaatagtttgaggagaattggtgttcttctttataagtttggtagaatttagcagtgaagtcatctgatcccagcatcccaaagatgttgggagactttttattactgattcagtctcattgcttgtcaattggtctgtcaaggttttctatttcttccttattcagtctcgataggttctatgtgtccagaaatttatgcatttcctctagggtttccaatttgttagtgtatagttgttcataatagtctctgatgatcttttgtatttctgtagcttttgttgtgatgtctcttttcgtttgggtagttttcagctattttgctaaataggtttctctgcctttggccttcttttcatcttttgaaacatccaaaatttgtatatttgtttgctttatggtgtctcatatgtcatgtaggctttctttattcttttttttttgtctgatgggggctatttcaaaggacctatcttccagttctgagcttctttcttctgcttgctctaatctattgtgaagctctcaaaggaattttttatttaatgcattgaattcttcatttctagggtttctctttggttctttttatgctatctatttctctggtgaatttctcattcacaacctgaattgtttttctcatttctttgtattatttatctgtgttctcttgtatctcaccgagcttctttaatatcattattttgaattctttttcaactatttctttttcattggaatctgttgctggaaaattatcgtgttcctttggaggtgtcacatttccttcttttttcatatttcttgggtctttacattgatgtctgcacatctagcataatagttgccgcttctaattttttggactggcttttataggggaaatcttttttttgaagatgtatttatgtgttggttggataggatactttagctttgattctgagtgcatgaagtagtgaagtttctctatgagttatttggctgtaaacagtgtcattagtgtttgtaatttcctcaatggcttaggctgcagttgttgtttgaggctgtggtgaggttttgctgtggatgaggacgccaggtgggccagtcctcaggccccagcgatggcagtagagggccgagcgtgcctgttcttgggcccatggtcagtgtatatggacaccggtgtcatctggtccaaactggctgaatttgggcttgcaggtggcttgataggatatcagcagtggcagtggtgggctgggtgggcgggtaggtccttggttctctgggtggtgtgtgtggtgtaggtgatggcgctaatggtgataggacgacttttgggccccaaagcagcatgtgttcatgttaacagtgcctgcaacaggctgggtgggccagtcctcaggcccccaacgggtatgtgccagtgggtgctggctgagatgacagcggcaggctggctgggcccatcttcaggcctccaggaggagtgcatagcagtgatggtcagggcggggcagtctccaagctcccgggaggtatacttgggcaatgagagagcagtgccagctagccatgcctgtcctcaggtccctggtggtgtatttgggcactggctgtggtgggcagggtggggcaataccctggacccctggtgcagtgcttgggtggcagcagcagtggtgagcaggcagagcaagtgtgtatgcaagtgtgcctccgtactgctgcttgggagagctgcagccacagacaggcagttctcaggccctggtgggggcatgtgctttagcccctggtggtggcggctgtggtagcagcagggaaaaccagtgtgcaagtacgcagaggtggccttgcttctgggggtggggggtaattgctagtggtgcacacttaggcccccagtggcagctgctgtgggcagtgttagagtctgttctcagagtctgtgtgaaggagccctgctactgtggagggattaaggttgctgtcagtagtagtcctcccaggtaggtggttcttagactctatggagcacgtgctttggctccctttgtcctggatcggggtgggcagcctctccaatgtgctgcaccatttgttccccagggtgcaggacactgtgtatggtagagtgctggggatcttgccacttcgctgggtctaatggttgttgtgccactgcagccctctgggtggatgttgggagatgttggtggggctctagggatgtggagatgtaggggttgttgggcttcagggcaggatgcagtgtggtgggggctgaagtctcagaatggcgctgtgctacagttgcttaggacttgggacgtgggctcactttctagagcaatgatgttgcatgatctctaggcaggtccttaagctgttctcagggcctgtgatgggtttttctgtggctagggctggcggagtccatggtgggaatattgaccactgtggatctctcacttaccctttcccctcactgaagagcctcttcgggctctcagccagtcttggccaaactggctgtcttgcgttcctctcttttcatgcctcgggtgtttcctcttacttcttagattccagtgttccttcttagatgctcagtttgaagattatatacttaatattttggttcttctttgtggagaagaggaatattggaagcctccagtcagccatcttgaagtgatttacctattgtatctttaaaaaatctcatggactattactattattacttacatagtcaatgtttgttgagatttacccacatatttagcatgttctttgctttttattcttgacatctcagacctttcatctgggattacttttcttctttctgaggtagatccttcagaatttcctttactgaaggtctgctagtggcattctgtcttggtttatgttcatttgaatatgtcattatttcagctttgtcctcgaaagacactttctgtgatggtaaaataccaggttggcagccattctctttcagtacaatgaagacattcttttgacttttggtttccattattgctgttgagaatacagctgtcagtatttctcctctgactgtaatctgtcattttaaaatctagctactttaatcttttcatgtcatctttggtgttttacagtgtcaccatggtagttctgtttgtaggttttgttgaatcttgatgtcttggcaaaaccacacatatacaaatacactgtttactttcattgtgagaaattaaggatttcagatggcacaagtaattcaaggttataaagcagttttcttgatagccttttgaatattgagtacaaatagtccaaaccatgttaaagtagaatttggaagcagttaagagtagaaacaaatgtatgcccactgctgccacaatctgttttataaatattcccagaagtccccagaagaactttgggattctggggaaagtatggttaaaaacttgtagttggcgttcacccaaagataatgcatgtgtgattcattttgctttttttcaggcatcgcttattaattatggataggttaatagtggttagtacagtgaaatactctttttgagtagagaaaacatttaggcaatacaccatttatttagatgtcagctataaaataaaagtacagttttttagatataatttgtatattcttgaaagcaaaatatttttctaattatttttcattctaatttttaacataacaattttcttctaatagaaaaagtaaatgctcaaagcaaaatattgggaaaagcttttggatacaactatcgcaagcagtgtggtatttggcttcatactacttttcttttctcttacacatataactttagaaaacacacacatggtcaaatcagtggagaaatgttgaaataagttatggtatagttgttctttagaataattatagaataatttagaatgagagtgtttctagttatactaagaaggaaagctctctaagatatattaagtgaaaaaagtaagtcccctcaaatatatacagtgtaatactgttatgtcaaaacaaaataaatatgtatttctatatgtacctttagaaatatgtgtgtaaatatgtaaaaaaaatctggaaggctatatatcagatctataatactgattatttctgcgaaggatgttgaatggtaagggaagtggtaatggggacttttgcttttatctgtggcttttttttaaaaaaaacaagaatatatttgtatataggatttgtgctttaaagtaaataaaatgacaattttcgtttgaaaaggggttattgtgtatattctgctttcttgcctattttttttcataatctgttgtgactgtattcccatgtaaaatatctctataaattgaaatttatgtctgcactgcattccattgtatggctgttccataatttacttaacccaatctctattttgttaagcatttagaatatttccagatttgttattaaactagatgatatgatgaatacttttatgtatatgtctttgtatacctctctgtttccatagataactttgctaggttaaggggtatgtttttaaggctgacaagtggtctttcagaaaggtatacccatttccgccaacctcagaagtaggtgaaagtgtttttttcctactctggccaaccttgggaattatttttcttgttattttttgctaattaaaaaaacaattgttttccaaaatttcatttcttagattactagtgagattgaatctttttctttccatgttttttggtcattaatattcctttatagtttgcctgctaatcaccttttcccatttttctcttagcgtgttttttcttattgatttgagtgcttcatttattgcacatatcaacgctgtgtcataaaagtaaaaacttttttccagtagtttgctttttaatgttaaagtttttttaactgagagaaatattatttattgacttgaatgttaaatactttaaatgtcttagagttaaataatttcaaaaggcacacataatattaaattaattgaattccataaattaaaaaaatctgtatttttgtttattttgaatgtttctattctttttttttaaacacatcattcaaatgacaatactttgaatatttcttaaaaacactggaaatgtttgctctcaacttttatataacagcttttccaaaatattttaaggtcgtagcacttaaaactttataattaataactaaagaaatacagttgcctagtttcttaaaaaatgtaacgaggcatctatgaatgctccttgataggactttacattaaataaatgtttatttaagctttactggtttccttttcaaggatagtaataaagtttaatttactttaaaactttttctaacaatttttaaaaactgtgtaaatacttctgtgatcagaaacagcaaaaatttgcattaggcttattaatggtagaaaaaaatcactgagaaacttacttggatagaaaattcagcaagctgtgtggctttttccctcttgtttatttaagttttcttttcttagctcttgttatgaccctacaatctttcaaagcccttagcttctggttggtgctgtcacagctcatcagatttactcacgagacccgtacagagtgtctggtgaaaaagaggaaaggaacatatgtgctgctgtgtccttggcaacttgcagaaggctgaatcacgcaaatgaaaacgaggcccattgtagattttcttcttgcaaacttatttgatcttgccgttttccgttttcaacgtgctcccccctcttctgtatcttatattttagttctctctaaaaaataatagaaatttaggaatgccctgtaagctaccgttttttccctcatattgccattcccatgtctccagtgcatatatacttataggagtatatggccagtcatttcattaaagtccaaatatttaatacatgaaagagcaagacaggataatccagcaacttagaatcagaactaggactaccttgttttgaaggctatgtgaaaaatttttttaaaatctcttatttttcttgtcttttttggggaaagtttgtaaactcattactattttgtctctataattttatttattaacataataaataaatacaaattattagtctttggagaaattagtcttttgaaaaactaagaagtaaaagattcttttaaaagtttgcccccagtattaattgctttcattattatgggatgttcaaagtttttaactttagcttcagatttatgtatcattgattgtaacttaatgacctacactggtctgaagtgtcatcttgtagcctaattctttaagcaattgtgaccttacagactaggaaggagggcaagcagcaaacttccagatgccgagtataaggttgcaggatcccaagggtatagaggaattcttctggtccaaagggaaccgtggaggaggggaaaacctagaatcaggaaagtgtagcaaagcattcctgtcctttggcatcgtaggctgccagtgaccatcttaactctttttgataaaaccttcccgtttattgggtcttctgtccccctacatctcacagatacagctttatttagaattggaactcagtggtaacatggcatttccttcacaacttacttaaatagaccttaaaggtaattaattattttgggcagtgttagctgcttctttgaatgctggtttattttatgggcaagtatgtgtgtggtttagttttttcttaattaaaactttaagggagtgggttttaaaaatctaaacgtttgatgttttaaaaaaatgtaactggtcactttagtagttttttttttctattttgaaaaactctaatgttttccttcttaactgtttcaaagtttgtcttttgggaatttttttgttcagcaaacaagaaataggtctactttccacactcccatcccattctcatttttaagaaaacaaaactagaaattgtggctgctttttgctctttgttcaggtatgcgcagagaggagtatgtggtatctgtaacttgtgcttcatctctctaaattttaaaattaagattttatagcttttaatgcatgtattcaccaactttctccctgtttttgtaggactgtgtatgttcagttacagccacataaagcagcactttttatttttctgtgtaacagtaggtcaaaagtggcagaggtgcatataactaaggttgtaaaaagttcgaggtgtgttagtcccactagaaggcttctgaataaacacttgagtatttacgtagatttttgcccttaatgtagtttataataaaatatggactaatatactgagtatattcagtactcttgtttggtataaatgaaatggttagaaatgctgtcaacctaaatgactgactcaaaagctatgaaatttaatacagctgatattttctttttcatatgaacagcttggaacaaatgttttgcttgtgcaaatgagatggctattatgatgcaaagaagcatcttggaaaaaaaatttcctttttctgttttaagtgttccagctaaatactgcaacaattgcaagcagagtctggagatttttctttcttgcttctgttgtatgatatattttagcaagttctcttgagactattaaaatgtcttggtttttaggacatgtgatcaggtggggataactttgtctatagatgcagtgggttagcagttagattttgcatgtcttctcatttctttctagtttctctgaccccgggtaacctttggaaggacctttggttcttctgaaggcaggagtgaaggaggtttgagcaggtgactgatgatcactgtctctacagtccacagacaatatacgaattactttagcagtccccttagtcccctcctcccactcctccccccttaaaccaacaaatgcaaatagcttcatccccatttgctagaaattcaggcttgctcaggcaacatgggctttgttgacttgctttctccagaaaggcaattttattcctggtaaggagcaaggctatcctatcatttggaacctaaatcaccttaacggtaaaaacagcaacaacttgtttctctggaatattgataaaggtacgaattactgcaaaagtttttttatattgtaattgaagtgtggttaaagaaattcattgtctgctttgttagcttttgtatactaaatatctcggtaattttggttatctcaaagatgtcctctgttttgttctaaatattacttattgaaattgttggcactattatttgaatagtcacttctaaaaattgttttatggtacagggaaaagtaagcctttggttatttctaccataaaaatgtttttttttctttttaaaaagaatagtcctattgtaagtcaagtttgatcatttaaatcaccagtttgtaatgacactgttgtcattttttaaaaaatagtttttagggatgtgacagtaaatgcttttttactggtattacctgagatttattaaaagtttttttatgatacaaaaatgtgaataacattttactaattaaatatattaatacatctgatgtgtttttttggaaattgtagcagagacagctaagatttttttttaacagtagcataatggaagttactctgtagaaataatttaggaagaaacaagatactaaggtttaaaaattgagtggcttttaaaagctcatgttgctagatgaattatgaattgacctaaaacaactgaagttgcttctttttgtgtgaactttcttctgaaaatattaaaagctatggagattatcatatttttaataatgtcattttgaccaaaatcttggttcttttgaagtaagcacatatgagtagcaattgtgaaataaaatagtcttcataagaagcatcccccatgaggctgaaggggggagtagtttacaaatagtgtcagtggttgattggcaagtagaaaacaaacatgttttaaaaacaagattcttagagcctttctaaattctaattgtgatttctagcttgttcttgcatttttatgattttctttctaggctgaatacttatggggatataattatataacagggtagggaaacgatgtaaattttactaaattagattttcttattttaatttagcatatatgccaacttaaaatggcattgtcacttaggtatggcggtagagaacaactttagctggtcttttgtttcttaaacaaaatacaggttagagaactatcctttaatgtctcattgggtttgggaaatttttcccagtaacattgcaagattccagtaaccttaagatagaatattctatgcagattaaggtataatgttttataagatatatgaagtgtttcttcttccttctttaatctgtttatcttaggtccccaagccctgttttgaagtgggggaggagggagtgaatcaaaactatagatcctttcaatatatttggttttggtttagttacccagacctaatttttaaaagctgctggaaaagacgtaacagcgcttcctaatgagaagttctgtcagacccccaaagcaatctaatttaaacgaaatctttacttttctgagtgagtgatttctttctttttgtgtcggaattgctttttattatatgtgttaaacatgtaatttttaatactgtaaaactgatatctttggtgttgagagggaaacctacatggaccatcaaggagactcaggaaggatggtgaaggagctaaggcagcagattctgggcttgttttagctcttgaactctggccatgtcatccatctctgcttgatagatgaagagaaccctctggttcaaatagggaaattggtgcaaggtccaacaagggttaaaatatgaaaaggcaggtacaatttttataaaaactggaacagctaccactgaaaattaaagactgtgttttcctttgtaacttcatcccttttccttgtggtgatcagttgcaaaacaaatctttgaaaatgaagggaggggaacaaaagggccttttgtgctcgttttgggtacagtaggaagtgggagaaagaatgaaaaagtagtatctcagagaagtttttaagtgatgatacaaggaagagtgctaacctgtgggaggcaaggttgaggtgtgggagggatgtctgactagaacagaggatgccctgttactatgcatggaggtagacactgtgtgtttctgacggtcagctacttgggcaacagaaatgcttttaccattatgttctgctgagtcagtttctttgaatgattactgcctgtagtactgaggtgatctattctttaattctgaaattgctggagactgagttgcagattattgtgttttatttgtgaggattctaaaggtcactgctggcatgcagtgagcctgcgtgggtatttctaatgttatttttaataggttcacatatgctagtctaaaaattttatagctgtttatctaaatagaatattataatgctaatgttaaatcatcattttctttagagacatctatgtatttagaatggctggttctattgttactcaaagaagtggctaagttgtttgtttttttggggacattttgtatttttaatgacaaaattggtatgtattatagaacatttagaaaataagtgataagaggaaaatctgaaaactacatgtattcttgccatctgtagattatcactgctaatattttggtatataaggattagaatattttaattaaaaatcaaattttaattgccagtagtcattgagaccaattgagggcatcttttaaaaagcatatgttgtattctattctatgtacacagaattgtattaatttcatctcatctaattaggtattcttattctgttattctggtagctaacagacttaaaatgtggtccgattgtaaatatatgaattagagaaattccacaggaaaatttaaattgtcaagaaagactatcagaaggtactccaccaatatttggtgcaatagtttttcttaaaggtatatttagtcaagagaattgaaaaaactcaatttttttgaggaaaaaacaaaaaactaaagcacctaaacatggacttattatttttagatttcagcttttattttagatacagacggtacatgtacaggattgttacatgggtatattgcatccaggtagtgagcatagtacccaataattaatttttcaacctctcctcctcctcacccccccgtagtctgcaatatctattgttcacatgtttatgtccatgtgtgctcagtgtttagctctcacgtataagtgaggacatgcagtatttgattttctggtcttgtgtttatttgcttaggattatggcctccagctccatctatgttgctgcaaaggatatgattccattcttttttatggctatctagtattccatggtgtatatgtaccacattttctttgtctagtctactattgatggccacctaaattgattccacgtctttgctattgtgtatagtgcagcaatgaacatatgagtgcatgtgtctttttggtataataatctgttttcctttgggtatatactcagtaatgggattgctgggccgaatggtagttctgagttctttgaggaatctccaaactattttccacaatggctgaactaatttatgtccccaccaacaatgtataagtgtccccttttctctacagccttgccaacatctgtttttttttttttttttgaggcggagttgcgctcttgttgcccaggctggagtgcaatggcacgatcttggcccactgcaacctccacctcccaggttcaagcgattctcctgcctcagcctcccgagtagctgggattacaggcatgtgccactgtgcctgctaattttgtatttttagtgcgagacggggtttttccatgttggtcaggctggtcttgaactcctgacctcaggtgatccacccgcctcagcctcccaaaatgctgggattataggcgtgagccaccacacccggccacgtctgttgttttttgactttttaaataatagccattctgactggtgtgagatggtatgtcattgtggttttgatttgcatttctctgataattagtgatgatgagcattttttcatgtttgttggccatatgtatgtcttttgagaagtgtctgttcatgttctgtgtccatttttaaatggggttatttattttttgcttgttgatttaagtttcttatagattctggatattagacttttgttggatgtgtattttgtgaatattttctcccattctgtaggttgtctgtttattctgctgatggtttctttggctgtgcagaagctcctttgtttaattagctcccacttgtcaatttcgttgcactggctcttgaggacttagctaaaaattctttgctaaggccaatgttgagagggtatttgctaggttttcttctaggatttttatagtttgaggtcttacatttgaatctttaatccatcttgagttaatttttgtatatggtgaaaggtaagggtttagttccattcttctgcatatggctagccacttatcgcagcaccatttattgaattagggagtcctttctccattgtttgtttttgttggtcttgcacaagatcagatggttgtaggtatatggctttatttctgggttttctgttctgttccattggtctgtctgtttttgtaccagtaccatgcttatagtatagtttaaagttgggtagtgtgatacctctggctttgttcttttttgtgtaggattgctttggttatttgggctctcctttggttcggtatgaattttagaatagtttttttctaattttgtgaagaatgacactaatagtttgttagcaatagtgttgaatctgtaaattgccttacacagtatggctgttttaatgatattgagtcttccaatccatgagtatgggatatttttccatctatttgtgtgatctctaatttctttctgcagtgtttatagttcttcttgtagaaatctttcaccttcttggttacctgtatctagatatttcattttccttgtggttgttgtaaatgggattgtgttcttgatttgactctaagcctggatattattggtatgtagaaatgttactcatttttccgcatggatttttatatcctgaaaccttgctaaaataatgtatcagttctactagccttttggcagagtcttcggggtttcctaggtatagaacatatcatcactgaagagagatagtttgacttcttcttttcctgtttggatgctttttatttctgactgttctggctagaacttccagtactatgttgaatagaagtggtgagagtgggcatccttgacttgttccagttcttaaggggaatggttccagcttttgcccatttagtatgatgttggctgtgggtttgtcatagatggcacttattattttgaggtatgtttgtttgatgcccagtctattgagggtttttattatgaagagatgttgggttttatcgaaagctttttctgcacctattgagatgattgtgtggttttgcttttaattctgtttatgtgttgaatcacatttattgatttgtgtgtgttgaaccaaccttgcatcccaggaataaagcctgcttgatcgtggtgaattaactttttgatgtgctgctggattcagtttgctagtattttgttgaggatatttgcctctgtattcatcagggatagtggcctgaagtttttttttctttgtcatgtctctgccagattttggtattaggctaatgatgctagcttcatagaatgagttcaggaggagtccttccccctcaggtttttggaatagtttcagtaggattggtaccagctcttctttgtatgtctgatggaattcggctgtgaattcatttgttctggggcttcttttggttggcaggttttttattactgattcaatttcagagcatgatattggtctagtcagggtttcaatctctttcttattcaatcttgggagattgtttgtttccaggaatttatccatttcctctagattttctaatttgtgtgtgtagagttttgttggttttgttagtttgtttgtttgagatagggtctcactttgtcacccaggctggagtgcaatggcgtgatcttggcttactgccacctcaacttcctgggctcaagtgatcctctcgcctcagccccacaagtagctggaattacaggtgtgtgctactatgcttggctaatttttgtattgttaatagagacggggttttactatgttgcccaggctggtctcgaactcctggattcaagcaatctactcacctcggcctcccaaagtgctgggattacaagtgtgagccaccgcgcccggccttgcatagagttgtccatagtattctctgaggatcttttatatttctgtgggatcaattgtaacgtcatctttatcatttctgattgtacttatttctattttctctttttttttctttgttaacctagctagtggtctatcaatcatgtttatttttgcaaagaacaaactcttggtttccttgatcttttgtatggatttttgcgtctcagttttgtttttgttttttttgagacggaatttcactcttgttgcccaggctggagtgcagtggcgcgatcttggctcactgcaacctctgcctcctgggttcaagtgattcccttgcctcagcctcccaaggagctgggattacaggtgcacgccaccacgcccagctaattttgtatttgtagtagagatggggtttctccatgttgatcaggctggtcttgaactcctgacctcaggtgatccacccaccttggcctcccaaagtgctgggattacaggcgtgagccacagcgcccagcctatgtctcacttttattaaatttgcctttaattttagttatttcttttttctgctagctttgggggttggtttttttttttctttctagttcctttaggtgccaagttggatttttttttttttttttttgagacagagtctcactctatcccccaggctggaatgcagtggtgcgatctcagctcactgcaacctccgcctcccaggttcaggtgattcttatgcctcagcctcccgagtagctgggattacaggtgcctgccagcacgcccggctaatttttgtatttctagtagagacggggttttgccatgttggccaggctggtctcgacctcctgacctcaggcaatccacctgccttggcctcgcaaagtgctgggactacaggccggagtcactgtgcttggcccaaagttagatttttaatttgagatctttgtaacttgttgatgaaggcatttaggactataaactttccttttaacactgttttagcagcatcccagagatttcggtaagttgtttccttatttttattaatttcaaagaatgctttgatttcagccttaattttggtgtttacccaggagttattcaggagcaagttgtttaatttccatgtatttatgtagttttgagagatcttggtagtgatttctatttttattgcactgtggcccaagagtgtgcttggtatgatttcagttttttttagttttattgagacttggctttatgactgagtgtgtggtcgattttagaatatgttctgtgtgcagatgagaaggatatatattctgtggttgttgggtggagtattctgtagatgtctattaggtccagttggtcaagtgttgagtttaagtctagaatttctttattagttttctgcttcagtgatctaacactatcagtgaggtgttgaagtctctcagtattattgtgtggttgtctgagtcttttcttaggccaggaagaacttgttttatgaatctgggtgctccagtgttgggtgcatatatatttagcatagttaagacttcttgttggatcataccctttatcattatataattaccttcattatcttattttttattggtttaaagtctgttttatctgatataagaatagcgactcctgttcttttttgttttctgtttgtgtgatagatctccattcttttactttgagcctatgagtgttgttacatgtaagatgggtgtcttgaggacaacagatggttaggtcttgtctttgtattcagcttgccattctgtgtcttttaagtggagtgtttagcccatttacattcaaggttagtactgatatgtatgattttgatcctgtcattgtgttgttagctggttgttatgtagacttaattgcatacttgctttatagtgcctgtgggctatgtgcttaaatgggttttcgtggtagcaggtgtcattctttcaatttcatgtttcacactcccttaaggatctcttgtaaggctggtctagttgaaatgcattctctcagcatttgcttgtctgagaaggattttatttctccctcatgtatgaagcttcatttggtggcatatgagattcttggttggaatttcttttctttaaggacactgaaaataggctcccaatatcttctggcttgtaaggtttctgctgagggtctactgatagtctgatgggattccctctgtacatgacttgacccttatttctggctgcctgtaaaattttttcttttgcattgaccttggtgaatctcataactatgtgctttggggatggttgtcttgaccgtctagctggtgttctctgtatttcttctgtttgcatgtcaacctctttagtgagattagggaaaatttcatggactgtatcgtcaaatatattttccaagttgcttattctctgtcctctctcagaaatgctagtgagtcatagatttggtctctttgcataatcccatatttctcagagattttgttcgtttttaaaaatcattttttctttctttttgcctgactgagttgattcaaagaagtagtcttcgagctcttgagattctttcctcagcttggtctcttctacttgttaatacttttgattgtattatgaaattcttgtagtgagtttttcagttctagaagttcagtttggttctttcttaaaatggctattttgtctttcacctctcacattgttttactggattttttggattggatttcagctttctcttgaatcttaatgagcctccttgcgcatccggattctgaattctgtgtctgtcatttcagactgattaagaaccattgctggggagctagtagactcctttggaggtaaagaggacactctggctttttgaattgccaaagttcttgtgctgattctttctcatctaggagggttggtgttcctttaactgtggtgtaagttgagtatagtccattggcttcatttctggatgctttcaaggggccagtgccctgtgcaggatctttatgtgtaggtgaattcttacatttgatttataggtgtatttattagcccaataatttttcgttttgtagtttgtgctgtgatccagtagatggcacttgacagtaatagctgtaggttgttaggttagtacccatccacgcttttgtacttcctcgtgtccacaggcatgctctatagtggggtacagaggaagagaagtggtcccctcccaggtctgctcctgggccttgggggagccccctctgatgactgttgtgcttgtgattcttttgttaggttttccaggttgtggtgtcctgtcgggcaggggttgcagtggagaaatacaccacaccccttctggaccggccctccgagggaggcacaccctgctcccgccctggctcaggaacctacatgtcttgcccctctcagggctctgagggtgggtacccctcctctcctcgagtggcagccacagatctcagctgtatactccctagttgcaggctgcagccgtggaggaactggaactttccgtggctcctggtcaggttccagctgtgctgggggatctgatgtgcttcttggttgctaggaaagtaatcagttgcagcaaggcactcaggctgggctgcaggggctgtgccgtgcacctgctcctgcacagtagctaggcattgggcctgggaggggctggtggcaggagggcttgcagagcaggcatgctccagtcccatggggaagctggcccagctctctcctggctcagagatcagctgggtgtctgtggctgctctctgccagagctgcccagcacataaaacctcctgggctctgcaccatccaaaggcctgtctctgcctccttcccgggtagatccccctgccaattcacatgtccatgggggatgcagggtcctctgtagctaaagtcacagaggtccgtggccagagtgagttgtccttcagttcttttacccctttctcaggagctgttcagggctgggagctagccttgcattcgggtaccctgtgcagggttcccagcttcctccctcttcagcctttgcttcagtggtgcctatccattcactcttggtgttttctccccaaagatctgcccaaattatggtgctttagttgataatttggtgtctctcttttattatttatttaatttcaaaatcgggtctcactctgttgcccaggctggagtgcagtggcatgatctcagctcactgcagtctctgccttccaggctcaagtgatcctctcacctcagcctcctaagtagctgggactactggcgtgtgccaccacatctggctaatttttgtagagatggggttttaccatgttgcccaggctgatgtcgaactcccgagctcaagtgatcctcccgcctcggcttcccaaagtgctgggattacaggtgtgagctaccacacccagctaatttggcctctcttggtgggaacggcacttcctgctgtgtctagttggccatcttctcccctattacactggattattaaggaagggcatgtcgatatttgttttctgtactactttgttctttttttttgtggtttatgtaagctccctcaaatttgaacgtgaaaaacatatttaaccaaaatatttaattctgttttatgtttaagtttatagaagaaaatattttgattaaaagatctcttttcattttcctcctcattaattaaaaatagtacccagtttaaacaaagagcataagcttttgggtaagacagttctgaatttgaatcctagttctaccacttctagactaatgtgtgatactgggttgggtggttacttatcttgctgagcctctgtttattcatatttaaaatagagataacacttgcttcacaaaattgtaaagacaaattttaatactatatgcagagtctatggcacatttgaggtttgcaaatttccttcctggacctggcatggtggctcatgcctataatcccagcactttgggaggccgaggtgggtggattgcttgaggccaggaggttgagaccagcctgggcaacatggtgaaactctgtctcttcaaaaaataaaaaagttagctgggtgtggtggtgcatgcctgtagtcccagctacttgagaggctgaagtgggaggatctcttgagcctgggaagtcgaggctgcagtgagccatgatcacaccactgcactccagcctgggtgacagagtgagaaccttgtctcaaacaaaaacagaaacaaattttcttccttgtttttatttatcccaaggttggtttttttgtttgtttttggttttttttttttagatgtggtgaaattcacataacataaaattagccattttaaaacgaacaattcaagagcatttagtacattcactatgttgtgcaaccatcacctccattttattctgaaacatttttatcaccttaaaagaaaaccctgtgcccattaaacagttgctccccatttctttctcccccttgcccttgttaatcaccaatctatattctgtctctatggatttacctattctagatattaatagtttgtgtaaatgggatcatacaaggtgtgaccttttgtgtctttcacttagcataatgccttcaaggtttatacatgttgtagcatatatcagtacttcattcctttttatgactgaatactattcctttgtatggatatgtcacaatttgcttatccatttctccgttgatggacatttaggctttttccaccttttggctaccgtgaatagtgctgctgtgaacataggtgtgtatgtatgtatgtcaatgtatgtatacgtatgtatgtatgtcaatacatacatacacacccatgttcatagcagcactactaccatatgagctaccaattccactcacatatatatgagtacgtcttttcagttctttgggatctgtacctaggagtggaattggtagctcatatggtaatttaatttttttgaagaactgccaaactgttttttttttttttttcttcttgagactgagttttgctctgtcacccaggctggagtgcagtcgtgcaatcttggctcactgcaacctccgcttcctgggttcaaccaattgtcgtgcctcatgctcccgagtagcggaactacaggtgtgcaccaccacgcctggcggatttttgtgtttttagtagacacggggtttctgttggccaggctgatctcgaactcctgacctcagctgatctgcctgccttggcctcccagagtgctgggattacaggcgtgagccactgcgcccggctgctaaactgtttttcacagcagctgcaccactttacattctcactagcagtgtacaagggtcctgatttctccacatccttgccaacggttgttatttgtcatcttttttattatagccatcctagtgagtatgaagtggtacctaaatttgcagttcttccttctgttttgaatatattctaaaaattaagttggtcgatgagtatttgaagcttacttttgccaagaaaatggtaaaatgttacgatcaagctatagtagtcaatttaatgcataaacaccctgaattgtttctatgagaacataagatcagagacaaaacctgaattttaaacagtcattaacattaacaatcagcaaacatttattggatgcacattatatggtaggccctagaccagatatttgagatataacagtggaacttaacatagttccttctcctaagggaactcacagtgtggtgggacagatagatatatgtaaataaagataagatgttataaggtctatgccaatagagataaatacatacagtatgtgtgctgtgtgagcatcatggtcctatgtttgcctgggtaacttattgctagaattttacagagctggtagttgagcagaatttcaaagaatgtgtaatagtttagccattgacaacaaggaagggaagccctttcctgaaaggaggatcgatctctgtgaagacagaaagagtgagaatggaagcctgagcagatgttgacgaaaagtcaaattctgtaaaatgtttgaagaggtttattctgagccgaatatgagtgaccctggcatgtgacacagcccccaggagatcctgagaacatgtgcccaaggtggtcagggtgcagcttggttttatacattttagggagacatgagactgcaatcaaatacatttaagaaaatacattggtttggtccagaaaggtgggacagctcgaaggtggggggacttccaggtcatagagttaaaatttttcgaattggcaattggttgaaagagttatcagtaggaagaaatgtctgggttgtgatatgaggttgtagagaccaagttttatcatgtagatgaaacctgcaggtagcaggcttcagagagaatagatcataaatgtttcttatcagactaaaggtctgtgttgatattaatgctggagaggtataacgaggcatatccgacccctgtttctcatcagacctgaaccagtctttcaggttaaattttaaagtgccctatcctagggggaagtccattccgatggttgggagtggggcttagaattttattttttggtttacacagatgattatggcagaatctataatgacagctgggaaaaaagatggggctatgaagatacacagagggcagatagtagagggccttagacagcagaccagggaattaagattttagcatgtaggtaatgtggcatcactgaagagtttcaagtggaaaagtgacataaatttgtattttctaaagatcatgcttatgggctagagtatggatcagaaagggcagcctggaatggcaattaagaggctaatgtagcttatgtgagaggttattgaagcaggatatttccctgaccccttcatgggtgggaactggagtgcactagctggctgctttggtgccggcaggggcaaactccactcacttggacctgctacattccaccccttgtgggaagaggaacatacaggtgggcaggtgcaggagctggggcgagtgcttttgggcgctggaaggagtgaactccatgggggccccatggcagcatctaggggggtacctgtgacccctgaagccccagagggagtgttaacagtcagtgttcttttagctctgccatccacagatggcttaagtgttaacagctcagtggagggtcagtgtgacagccttttgcactcgcacttgtggcacctgagttcttgtctggcatccaggaggaatgaggttgcatgagtgaatttgaagtatagtaaatgtgggggattttattgctgatggaggtggctctcagtgggatggggaattgaaaaggggatggagtgggaaggcaatcctcccctgaagctacactggcaagctgtccctctgaagtgaagccgcttctctgtgatgtccaaccatagtctctgaggtccagctacttctcctcactctgccagctgagactggggtttttatgggcacaggatggggggtaaggggggccatgggtggttttggaaaaggcaacatttgagcagtaaaacagagatgtaagttctcactttgggccatggtatcaagctttttggcttgagggtaaggcccttgctgggaacccaccctcccagaatttctctgcctcctgtttctatcattatgaggtcctgaatcaagtcattgacaggcatgaataacacatctgggaaatacttgggaggtaggcttggctagacatttggagggaggaagcatacaaggatgacttcaagatttctgacttcagataggtaatgtcgttcatcaagatagagaatttaggataaacaaaatgaattctacttttggaaatgttgaatttgggatgcttatgtagatatctagttggctattgaaaacatctctggaacttgcaagaggcctatgctagagagagggagagagagtatgcaggcatgtgcacaagtatgcatgcacttgagcaggcaagagaacgtgagagtgaatgatttggtaatcattactataggcagtagctgaaataatgggactgaactagagcactcaaaactgaggtggggatgggggagaaggcagtcaatcatgaggaacactactggaaaagtgacggaagtaggagggaactcaggaaagagttgctatgtgagacttaaagaattttgaaaagaaggcagagtgtctagtgctaaaaatcaagtaagatcaggaagaggcatccattgtcaatggctgttaggaagttgttggtgatattaacacacaaaggttccctaaaaggttgtatctgtggaaatgttgttatagcaggttaaaaatgagaaaatcgtaataatagtgaacatggactagtctttaaagaagcttagtcttaaaaggaaatagagaaggtattagctggggagagtgtaggtaagtaggatttccttctttggaggaaacttttttccttccatttgtcaggcagtggcggcaagccttccccagtctctaatccattgatagaagagggcaaggaacacctttagggcctgggaaaggagggtaggaatagagacagggatggtgatgtgagtgttgctgctgttgattaaatgtgccacgtgcaaaatttaaataatctgccccaaatctcataggaggtattgtgtggcgaagctggatttgaacctaattagtatggaaccagtgttcctacaatagatagtgagaagcagggaaaggaatagctgtaaagagcaattggtaacagagccccatgtccatgtgatctctaccccacctcttctgagaaaattcttagtgttcagctggcttctgacttccagatgcctgttgtgataagtaccaggaacatgcttccttgttttcctttccactggtatctaccccttgtggtttccttctagagttttcctcagcctttgaggtgttcttaaagggtattttgttgttgctgaaaataaggaaataaacatacatttaaaggacttctatgcttatggagaggtaaagtcactcttatctgacagtaacagtccttgagtattcaaaaggtattttcagaggaagagcagacttggttgttacgaatgtttaattcccaaagcaaggttgacctctgggatgggacgagtggctcttctgatacaggtagggggaagggagagaagaaatagagcagtatctgaagacaccagtcaaggaagccagtgttatggtatgggatggcagcaggagcaaatgaaggaagctcacggggtttatacctgacctacctcccctttgctcttattgctgcccatgattgattagtttgtggcaatctgggttctgtgggacagggagcaaagttccaagcagaggcattgggcagcacagctgagtgtatatgaactctaggcttcctttaagtgaaaaggtgaaagttgttgactgaataaggaaagacaaaaatcatatgcttaggttgccaaggtctacagtaagaacaaaacttttatctatgaaattgcaaagaagggaaaaaaaattcgtacatagtatatatggagtctgatactatcggcagtttcaggcatccactgggcaggggggtgggggagcatctcagaatgtatcccccagaatatatggataacggggggatactctgcttgttaatatttttccctataaacatgctttcacatctgattttttttttctaaacaagagtccctgtcagagagcacctgttgactattgactatatagtgaaacagcacataggagttcacaaggttgtccactgggtcattaaaaaaaaacacacacacacatgcatcttgacttgggagtgaatttgatgatggcctttttgttgttgttgttgttgttacaggacagaaagcagagtggcatattggaaaaggcatgagcttaggaggcaaacactcttaaccacatgggtgctcttggctcagttacctaacctcacagagcctatgtttcctcatgtgtaaagtgaggaaacaatatctacctcataggatgtttgggaggatttcatgcaataatggatattgaagtgcctagcatgtaatgggtagccagtaaatattggcacctatctcctttctttctctagtttccctcattccaggcttccagaccccctgttggctttactccttgccttctagattgtttcccaagatttgttaatttctttttcatttccacaattcaataattatcatttcttggatgtttttcttacctggacattttctgttctgtctgaagataagctgaagaaccaggtaaattttgtgttggttgtttacataaaagttttattaaagatgagtagcatatccttctttatatttcacataactttttcaaaaagatttttattcactttgtgaccactatgaacacacaaagtttgtgtgttcatatacatatgaacatataaagttttatatatagttttaaccttatttaaacaaatccatttcctatttcaagtagtttaatactgaatagagtttcagcatggtgtgtgtgtgtgtatatatgtatgtatatctatatgtatgttatatgattgctcctgggagtttaattttgatgtgtaatatattgaatggttactctttcctttttagttgaatcggcttaaaaagtattttattctaggtgctggggatatggcaataaataaaatcgagtccttaggaggctgaggtgggaagattacttgagcctaggagttcaaggcttcagtgagctatgatcacatcacttcactcctgcatgtcggcactggacgacagagtgaaaccttgtctcaaacaaaaaatgaaaaacccccaaaaaactgagtccttgactttgaaaagcctgctttctaaagtgaaattttgttcatatgtaaaaatttttggccgggcgcggtggcttatgcctgtaattccagcactttgggaggccaggtgggcggattgcctgaggtcaggagtttgagaccagcctgactaacatggtgaaacccagtcgctactaaaaatacaaaaattatccaggcatggtggcacgcgcctgtagtcctagctacttgggaggctaaagcaggagaattgcttgaaccagggaggtggaggttgcagtgagccgagatcatgccactgcactccagcctgggtgacacagtgagactctgtctcaaaaaaaaaaaaaaaaatttatagtactttgtttttaactttgctcatacatacatatatgccatacatcaaaaaatttttattataatatagaacaaatatatatactttaggggactatttgaaactatagcttcagttttcaaatgccaaaatagttagatcaaatattgatttcattatagttgccatgttctgtaaagttactatttgctacaatttaactgcttattttatatagaatatactagttttgggggtataacattgacttgcaggctgaaaatatttttcattcgttcattcagtattttttgaggacctcctatattcctaggttctgtcttaaaccaacctggcacaggaatttgaacccagatctggagctcaattattcctcttcttcattctatatatttagagttggggactagaactgtagagatcagtagattggtcaagagaatgaacattttatttgggtttagtaattgtgttagtctgttttcatactgctataaggaactgccccaaactggataatttataaaggaggtttaattgactcacagttcagcatggctggagaggcctcaggaaacttacattcatggtggaaggcaaagaggaagcaaggcaccttcttcacaaagcagcaggaaagagaggttccgagcgaagtgggaagagccccttataaaaccatcagatctcgtgagaactctcttactatcacgagaacagcatgggggaaaccgcctccatgattcaatttcctccacctggtctctcccttgacatgtggggattatggaaattacaattcaagatgagatttgggtggggacacaaagcctaaccatctcagtaactaaaaagaggtcacttaatgaccttggaaaataatttctttaaaatatgtttgggggaagaaaagtttattacaggggctaaggaaatggaataataaggaaattgaaatgtcaagtataggtaattcttcttgatgttttattcatagtagtgagtggaaagagggaattccctcaagggcttgaaagtgtatcagaaacagggaggtaacttcaaaataagggatatgtgaaagtagtaagagacagcaaggagttggggattgagtgatcaaatattgaggagagaagagataattgaaaccaaaatgtcccataggaaccaaagcaaggtgttgttaaggcataaataaaagaagattggacttcgaaaactagagagaaaacttttctttttttttttattattatactttaagttttagggtacatgtgcacagtgtgcaggttagttacatatgtatacatgtgccatgctggtgcgctgcacccactaactcgtcatctagcattaggtatatctcccaatgctatccctcctccctccccccaccgagaaaacttttcatttgatgtaagagaaaaagatgagaatgattgaaaaagtattttaagatggagaaatgggatttttttttttttttgagatgaagtttcactcttgttgtccaggctggagtgcaatggtgcattctcggctcattgcaacctctgcctcccgggttcaagtgattctcctgcctcagcctcccaagtagctgggattacaggcatgcaccaccatgcctggctaattttgtctatttagtagaaatggggtttcaccatgttggtcaaactgatctggaactcctgacctcaggtgatccacctgcctcagcctcacaaagtgctgggattacatgtgtgagccactgcgcccagccagagaaatgggatttttaagtttacccccaaaggggatagcctttaatcttctcataaagtagaagattgggtcattccctgaatggaagagagaaagggagatgggaacttaaatagggaaaagccttctaccatggaaacatacttggaaatcagtgagttgcagcagtgactcctcagttgaggttagcatggattttatagacaccagtagcatcttaatgttctaaagcaagagttggcaaacaatagcctgagggccacatccagctcatgtagcttataagctaagaatttttttaatattcttaattggttgtagaaaaataagcaaacaaagaaacaaaaaagggctgggcgcagtggctcacacctgtaatcccagcactctgggaggctgaggcaggtggatcacgaggtcaggagattgagaccatcctggctaacgtggtgaaaccccgtctctaccacaaaatacaaaaaattagctgggcgtagttgggcgtagtggcgggcgcctgtagtcccagctactcgggatgctgaggcaggagaatggcatgaacccgggaggcggagcttgcagtgagctgagatcgcgccactgcactccagcctgggtgacagagcaagactccgtctcaaaaaaaaaaaaacccaaacaaaaaagaatgtacgacagagaccttatgtggccttcaaagcgtgagatatttagtttctggcccttcctggaaaaagatagctaacccttgttctatagctcaggaccagagaaagcagatgatagtgtgactcagagatggggactgacattctggacatgatcaaagatcaaagggtgataaaagaaggtatactagttaggggtttttggtggaggtggacagttgggtgcaggttgagtagagagtaaagcaaagccagaagaaagctaatggattgcatgaaaatggaatatgggcttgtggatagatgtcataatgagaatgtaaagcctgatcagttggtttgaagcaaagataacaggtaaggaagttggaattggagaaaggggacatggttggttgtcttggagatacaagagtttcagaaattgccaactacagccattttaggaaatagctgaactctccagtgataaggtcaggatgatgaagcatccaagagtacgatggtcagattccttaagatgaagacaggaagactatgtatgcagaaataatgtgtgttaggttactggactttttcaaaaaagtggaagtgagcctggagtatgaagtagatgatggcaatgaggtaaaaagaggctggtgtaagtaggcaaactacttgtaaatgagggggaaagtgatgttggcagtgaagtggtcctctctttgccctggcagctcaggataggctgttccttccttttggtttggtaagtggtagaaggtagatgaaaaggccgtaggaaagatgtggtattatctattgcgggtcagatttacatgtacatagtctttgagtgtgggaggaacaaagcagcagattggtttggagttgtaaaatgaagccctcaaaataacagtagttgatttttgcatagatgtataaatgtttcacttacatagttcttcctgtaaagaatttttttaagcattagtgctttttactatgtaaaattcatttatttgtaataatgaaattatcaaggaattaatactaaacatatctctttttacttaaatgtgaacatggacaaaagtaacctggcaggtaacctttatttgaatattgaaactgtattgggctacaaggaaactagtagctacaaatcacttgggcctgatagtgatctttccatgacaacattaatgtaaagtctctattttagtatatgaaactttattagtagacatacatatagggacataatgtatatcaaccttaaatatataatttttatttgccaattatacctcattaaatctgaaaaaagtcaagagcaagggagcccctgccctctgaaacatgaagcaggagccctaggcaattgctttgctatgtttttctatgttgatgtgagagatgattcctgtatatgacataattggatagtgtattctgaaggaaagactcctttttgtgcttcccataaaaatatgggaagttcctaataggtaagttgctaggaatttttaccatgctaagttgaagttactgattcctctaataaaaaccgctttattttttctggagaattaaactattttcaaataatatgaaatcttaggatacctaaaacttcatttcagatggtacttttagttttaagtggttttcagtgaataacctttggaaatggttttaaaggtcgagtaaaacttattttgagtcatgaggagacaatgccttaattgtgtcatttactttaatattttttgtatttttttcctcagttcctattgtaaagaatatagcaaaaacagagtcttctccttccgaagcaagccagcattcaatgcagtctccacagaaaactactctaatattaccaacacagcaggtcaggagatcaagtcgaattaaaccacctggacctactgcagtccccaaaaggagcagttctgttaaaaatatcacaccaaggaaaaaaggtccaaactcaggaaaaaaggttagttgtatgtcctcctaatttgtattataggtttttatagtgccttattatttataacatacaatttaggaatttactaagagtatgatgagggtctttagaaatgtactaagagtatgtaggcttttgaaagcctcacataactatcgatagattgttatttctttgcttgggcaaacttaaaactttttatagtgttctacttcttcaaaaccacaatgaaagtactattaatacatgggtgtatttatgttcagactagttagtttgaaactcagtatactttaaaaatcaatgtgaagtgaatcttactgtacatatattatacctcaataaactggggcagggagagaagaatcaatctgatgaattcaataatgctggagtcaactctaaaacttagaaataatagaaaaagcaacaacctgaagacactgaagagtgaatggaagcagacagattctggtggcaggggaagtactcactgggataaggggtgttatacaaagtgagtttccattgttgtggttttaagccttaggtcaagtacactttgtgtaccatgtgaaacaacaggagtattagtagaaaaacaacaatttatctggcctagggaaaccagaaaatagaaaagccaggaaaactgtggctgttaaagggaatggagggattttggaagggaaaggaccagagaggttatctgcaaattctgtctaccaacgtctctgacagacccctgatctgagcatgtttgtctaatacacaacaggccggtgtagctaaagcaaaagatctgaactgaggctggatgaaattaggcccaagatcagaatttaaagttcaagtccagccaaggtaattactagctaaacaaaagaaataacaattatcagagaaatatagaatttagaatctgcacaaattaatatttgtaacatctggaatgtaattcacaattacccaaatacatagtaaaatgaataatattttcaagaaaaaagaaaatcaactgagacagacccaagtataacccagatattagaactagcaaacaaaaattttaaagtggctattcaactggtcttcgatgacattacacagacacacacacacacacacacacacacacacacacacacacacacacacaatcgtactgattaaaaagaccatcttagtggagaaacaaaggataaaaaggagccaaattgaaactcaagaactgaaaaatacaatatctgaagtaaaagattcactggacaaaattaaccagaattgactggagatgacaggagaaagagtaaatgaactggaagatagaagaatagaaattatccagtgtgaaaaactcagactaagattgagaaagaaaacgaacccagagaccttttagataatatcaaaggtccaatacaatgtaattggagtcccaaaaggaaaagaaagagaaactggagcagaaaaaatatttgaagaaataaagtctcaaaattttccaaatgtcatgaaagaaatgcatagacacaatactcagccaagagcaaacagaataagcacaaagacatctatctaagctgaggcatattagagtcaaactgttgaaaaccagagacagagcaaatcttaaagataacaatgtaagaatgaaaaagtacatgcagagaaacaaaaatttgattaacagctgacatttctcatcaaaagccatggaggccagaagagagtagaacaacatctttaaagggctgaaaggaaaaaaaaaaaaaaaactatcaacctgaaattctgtatctatcaaaaatactcttctagaatgaaggtgaacttagaatatatataatttttgtttgtcaattataccttaataaagtagaaaagattccttagtagaattcaatagttttcttcatataatttatactctcgtttattcttatttatttctgcatattttatgattcttgttgctattgtgaaggaaatcttttccttattactcttttctatgaaacaaaagatataaatatttcttaaaaagaatgaaggtgaggacattttcattttcagataaaagcatactaagataaatcattgtcgaaccagcactgcaggaaatgcttaaaggaaaatgagaccagatggaaacctggtttctcaaagagaaaggaattgttttgaagatggtaaatctttgggtaaatgcaaatgacttataataacatgactatttataactaattacaatacagtgttgcagagtttatatttaacagacatgaaacaattgtagtataaaggcctgacgtgggggatatggatcctatatcattgcaagatttcaccattttatgtgaagtggtacaatattaactttatgtggcttgtagaaagttaaggatgtacattctaatccccagggcatattgtaaaaaaaaaaaatgcaaagaattatagctaaaaagccaatagaaaattaaaatgtaattctaaggaatatttgaatattcaaatatattcattataaaatattctaaggaatataaactgttaacaaaaggaaaggaggggctgggtacagtggctcatgcctgtaatcccagcactttgggaggccaaggcagaaagatcacttgaacccaggagtttgagaccagcctgggcaacatggcaaaaccccatctctacacaaaatacacaaattagctgggtgcagtggcacacgcatgtagccccagctacatgggaagctgaggcagcagcagagttgcttgagcctaggaggtggaggttgcagtgagctgagatggtgcctttgcactccagcttgggtgacaggagtgaaaccttgtctcaaagggggaaaaaaaaaggaaaggaaaaggaggaacagaaccaaacacagaggagacaaatcaaaaacaggcaatgaaatagtagacccagccaggcgtggtggctcacgcctgtaatcccagcactttgggaggctgaggctggtgaatcacctgaggtcaggagttcaagaccagcctggccaacatggcgaaaccccatttctactaaaaatacaaaaattagtcaggcatgctcacaggtgcctgtaatcccagctactcaggaagctgaggcacgagaatcgcttgaacccaggaggtggaggttgcagtgagccgagatttcgccactgcactctagcctgggcaacagagtgagactccatctcaaaaaaaaaaaaaaaaaaaaaggtagacccagatccaaacatactggtaattgcatgaaaagttagtggattatcctttctagttaaaaagacagagattatcaacatggatttttttttaaagacccaaatatgtcctgtctacaagagatgcactctaaatataaagacatagaatcttttcagatctcttgtggctgactgaattaaatgccagcagtattatcttacacattcctgagttcagccatccgatatcagtatctataacatttccattttgtttcaacttatgtttgctgtatggaaaaaaaataacattgtgattttaaaatatattgatactgttatttttctttaaaaacactcaaaatttacaaaataaaaatcaaaagtcaaagctaaatatttcaaaaatatagtcatgaacattgaaaaaaatcaggcagattgttctaatataaatggtagcagatgaaattttttaaatgaaaaataaaagtaagaaaagttaatagtgaaatttaaagtgaaataatattttaaatgcattaaaaaattaacatgtgtgtatattttccagcttctgaaatgtctttgtgattagttggtataatggtgaaaatgtaagataacaccaaatagtttcctttgactcctttagtttccagttccaagctaatttgataattttggagagctctctttgaaaacattgtttatttgatgatggggatggagaaggggcaggtactttaatcttttaaaaattattttaaaagttttttactttttattatgaatacataatacttgtatgtatttatgggatctatgtcatatttggatacaagttgtcattttcttcctccccttaagggaggagtgcaggagcacattttcttaatgaatgtacctttattcaatttgcagtgttaatgcaaacatactatcttggtatgtctcaagacaaaggattcagatttcagatttttaaaatagtgaaagaatgacatggtcaacccagtaattataattcagtactgaaaaataacatgattgtgtccaggcagtggcgcatgcctataatcccagcactttgggaggcggaggtaggaggatcccttgagcccaggagctcaaatccagccagggcaacatagcaagacaaaaaaaaaaaaatcacattttttgtttctttaacattgataaagaacactgtatcaatgttaaataaacaaaaaatgtggtttactagattactgtcaacccaaacgacagccattaatttaagcaaataaatttcagcaacatcgaatgttctattttttactcctttgttcctgccttttaaatgccctctgttattaccttttctatgcacaggagtcccttctcttatattggagagtcatgtttgaaggtagctcctggaaaaccccaagagttgatgtaaaataaacaaaatgctagtgaagtttaacaatgctcaggaaacattggttcttataggcagtaggcataattttgtatagactttagcaagccatctgttgtgattttgtcagaattattgtatgtaatatggagaactgtgggttagacacagcgaagactaactagatgagcaacttctttctgaaaataaactctgtcctctgccttgctgagattttttttctattggaggtattgctctgggttagagatttacagacttttctttagcaatgtgaaaaaacttgtcttacagggaacctcaaaaaataaagtatgttttatggaataatctaatttggctaaggtgtgattagttggagcaggggtaggacagggaatcccagccatttggtctctttctcccctacctggacagtttgtggtcctctgagaagctcagtttggaaagttctgcagttcatgacacacacgggagtttccaacctgaggacttctgataactaataattttataaaccaatgatatttataatttctgactttcttatctaagaatatattaatgagtattgtatacttgtgtttttttccctttgtttttaacaggaaaaacctttgcccgtgatatgttctacatctgcagcttctctaaaatcgctgaccagagaccgtggcatgttatataaagatgtcgcttctgggccatgtaaaatagtgatgtctacaggtaaattcatattttaaaaatagtatagaattactaatcttttatcctgtattattttcagtgtcttcgaagtcctggaaataaaataataagggaaaaagatggtaatattaaacatttatctttgcatttttcatattaaagtattttgaaattctgattgttccattttacattaaggaaaaagtctttaaatacatgagtcacttgaaaattcagatactcttaaagtattttatccatttaagtaagatttatgcaatttacattgtccaatctattcttgttttccctttatctcatttcaaaatttgtctttttgtatggtatgtattttcaaagctgcctcaaaccttttcttaatgccttttaaaaattatctcccttacactctcctattccctggacttttttttccttttaatttttctttcctgactaaaagtaaatttagttttttaaaaatagaagtcactttaaaaatgattgttgtaacatatctcatttttttcagtttattatttctgatttttaattagcaggaaagactagctaaatggatataacacaaaggagataaaacattgaaatccttgtttagcttcgcttgtgttcagtagaatttgtccatgtcatcagcaccgtgggttgaatttttaatagctatttcatttctgaaggataacagtccttcctctggctgttgccacaaaattgaattgtatatttcaacagagcaaaactgagattgatcagttttcttatactaaatatagactatgtgtgtgtgaaagttttgcaatattaattaatggattaaaaataacatgcttcttagggggacaatttattttatttttggtagtgatgtgccctcatgttttgtttctttgttgttttttttttttttgagacagtctcacttcatcacccaggctggagtgcagtggcgtgatcttggctaaatgcaacctctgcctcccgggttcaagtgattcttctgcctcgcctcccaagtatctgggactacaggcatgtgccaccacacccagataatttttgtatttttagtagagatggggtttcactatgttggccaggctggtctcaaactcttgacctgagttgatccgcccaccttggcctcccaaagtgctgggattacaggcgtgaccaactgcgcccagcttccctcatgtttttatagtgtatattgatttgcatttgttgattctcagtaaagaaaattattggaagttggcatttatgtgattatagatgaattgcttctatatcatatgcttttattatactaaggaaagagtttattttaaaattttcttccatgaatcttggtatatatagaaggaacatttttattttcctaaaattaataaaatattaatatatatcaatataacttgttatatatatcttaaattgtttggttactttagaaaatataattgaggtgcagtattggtgatttaaaataaattcagtccaaaaaagagcatagcaagatgacccgttttgaaaggaaattcttgtactgtgtatacaattaaaagatgaaaatattcatctgtctttgtgccattttatataatgtgggaatgtatgaagaattgtttttgtgatgtgcctaaaatgtctgtagattttatatcatcagtttggacaagattctaaaaaattgaataaacattttgattgtttctttgtgggttcagtgtctttgcatcaatgtaaaaatatatttacatatttttaggtagcagaaatgatcattgatattaactatatttaggttttctgtgagtgaagtggatagtgggatatagtaattgattatgtagtgttttcacaaaatttcttttaatcagtctcattgttatgtatgcatacgcattttttctcaagtctgtgtctatgtaaacaaacatggaaactttggccctcatctggatcccaagagaatccagcagctgcctgaccacttcggcccgggcccggtgaatgtggtgcttcgccggattgtgcaggcctgtgtggattgtgcccttgaaactaaaactgtttttggatacctgaagccagataatcgtggaggagaagtgataactggtatacttatctaatacattgtctaattcagtcccttcccccttcccttcccccttcccttcccccttcccttcccccttccctttcctctccccttcccctttcccctccccttccccctcccccgccctttcttctttcttccttcatctttttagaacagggtctcactctgtcacccaggctggagtgcagtggtgtgatcttggctcactgcagcctccacctcccaggttcaagcgattctcccaccttagcctcctgagtagctgggattataggcatgcgccatcatgcctggctaacttttgtatttttagtagagacagggttttgccatgttgcccaggctagtcgtgaactcctggcctcatgtgatctgcccaccttggcctcgcagaatgctgggattacaggtgtgagccaccgcacctagcctgtaatatttattatattagtataatagaacatttataggagttatatgtttatagactttaagccctggtttgaaaagtttacttttaaaatggacaaatgatgtcagaataatgtaaattgggacaaaagtcacagattcttcgttttacatgctgtgttaagctcactataggcagagtaccttggctgataatatattttatctataagaagctctaaataaatatgtgactcaagaagtcactaagcaataagatagtgttggtggctatgatcagacaccacaacattcatacccatggaatatttggaatagaaggaagtgttacatagatcagtgagtttctgttgttgttgttgacttaagagtattttcaaatgaggatgtttttaccaatacaggctattgtgtttgagaggagcttttataatataagatcattcctttatgaattacaaagaacacaaattagacttataatacctttcctaaggtgatagttttttttttaattagtgttgtatttctcatctctctgaggttactgacatccttttttttcccccaatagcctcctttgatggggaaactcattccatccagctccctccagtgaacagtgcatcatttgctcttcgctttcttgagaacttctgccacagtctgcagtgtgataaccttttgagtagccagccttttagttcttccaggggtcatactcacagctctgcagagcatgataaaaatcagtcaggtgagagaaaatgtaaactcttacacttctgtttcacttgagaatcttgtgtaattgtttttccttgtgttctcctcaaagtaaacattttagccacagtgaactaattagaaatgtataacatatagttgtttttgttcattcaaaataggaaagtaatttcttgtattcataatgaacttcagaatcaaagcccatggcttacttatgtttggcttcattttgactacctcacagagttaaacattctctattagactgaagtatggctttaaagttactgacttttataatcctcagaagttagcaaagcgtgttgagcctattggctataaagataattttgttgtcattgaggtttgacaaatgatgatacggttttgttgttgtttttggagacagagtctcactctgtcaccccaggctgaagtgtagtggcacaatctcggctcactgcaacctccgcctcccagattcaatcgatcttcctgtctcagcctcccgagtagctgggattacaggcgcccaccaccatgcccagctaatttttgtatttttagtagagacagggttttgccatgttggccagggtggtcttgaactcctgaccttaagtgatcctcccgccttggcctcccaaagtgctgggatttacaggtgtgagcctccacacccagcctgtgatatgcttgaatttgacatttgaaccatggttgcttctcttccataagaaccccaaaccgatgcctgaataaaagggtaggtgtaagatagccctgtagaaccaaaagtgggtttcttgcttctgatccctaaagcaagaaagctctttcagcttttatgcaagtgctgtttgttttttgggagtggtttgtctctttttcatgtgactcatgaaagctaactgtgttctattgatcatggcaggattgtatgtgggtcttttaagagtagctgaagttctcaggtgttattgccgcatggttttctggccagctgctgctgattctggaaatacagagtaccatcacagactatctttttaagtccagggattctaattcacgtgccactcaagtgtgaagcgtgggtaccacgtctctagctactacttttttttctggtcctcctggttaccctcacccttcttcataaagcttgtctcctctacttcagtgacatctctcatatccatccccttttttccatttccttgttactaccctgcttcagactgtactaaccccttctctggtttagtaaagcaggcttctaactggagtcctctttccagtttctcccctctggtgtagctgtccagtgagtccctttgaaataaaggtatgatactgtgacatgcttgcaaaaagtatacatggagaagcagtggcatggagagcacaggtgttggagtttgtcagacctgggttccaatcctggccttgtaatctctgctgaaagagtataaagtctgaccggcctacattttaattcagttcctgctgttaactagctatgtgcccatagacaaagtactgagcctctctagttctcagtttccttatctgcaaagtggatacctctttggttgtgaaattgaaagaaagtatatgtaaattcttagcctgcattatgcctggcatgaagtaggagcaataaaaggtagctgttagaactagggggaagaggaagagtgaggtttcatgttttcatgtgatattatcctttttttttccttcttcaggagaggtaggaggtcatccaaaatggtaggaaatttggaagatggctaggaagggaagggccacctgtgtgggaagaggggtgtctgtgtattgataggttttctgtttctaagagtaatttggggaaaaatacgagttggagatgttgagagtacaatttcctgatttctttttttttggacacagagtctcagtctgtcacccaggttggagtgtagtgacaccatctcggctcgctgcaacctccgcctcctgggttcaagtgattctcttgtgtcagcctcccgaatagctgggattgcaggtacctgccaccacgcctggctaatttttgtatttttagtagaggtggagtttcaccttgttgaccaggctggtctcaaactcctggcctcaagtgatccttccaccttggcctcccaaagtgctgggattacaggcctgagccaccatgccaggcccaatttcctgatttcttacacaaagcattaagaatgccagtaatttacaaagcctcattctttgaaagattttaaagaaaatgtaattcttctttaaattgaacacaaaatgtttgaattttcagattaatcaaataatcagaataggtaactatttgaaaaaatacactgaataatccacatattttacattattttaggggttattaattttctgtcacagaaagcttaatttagccatttgaaaatggctttgagttggaactcttatgtttttcttaagtcagcttgtagttaaagaagttgcatataaatgctatgaggttattactaagatttcacgtctagtatcccatttctcttacattttttaaaataagtgactcaaaaatagtttaagatagagtgctcttcttaggagactttgattctgacaaatctagtgtttgcatattttagcagtaattttgaagacattttactgaagtatagtatacatagagaaaattatacatggaatgtagcttgattaattttcatgcctgtataatcagtcactggttggaaaagtagctattactagtaccctagaagcactgctaatgtgtcaaaccccctttaatccactactacccctcacttcgcacaaggatacctactgtcctgacttctagtaccatatattacttttgcctatttttgaactttatagaaatggaattatacagcatttactcttgtgcctagcttttttggcctatcattatgtttgtaagtttcatctgtattgttgcatatagttagatcattcattctcattgctgtataatattctgttgtataaatatgctaccatggtatgtatccatttgagtgctttctgttttgtgcccttataaatagtgttatgttttgtactcttataaatagtgttatcatgaacattctatacacgtctttctgttcctgtatctatcttggagggaattgctaggtcacaggaaatgcatagattaagctttagtagatactgccaaacagtttttcaaagtggttgcctcagtttactttcctatcagctctctgcttttttaaatagattataattcttaggtgaaattttttattctttgatcttttctgtccatttttcctgttttcttgaacatattcatcaaaattgcgttatagtctttgtctactgacaccagtagtttttctctcaatagttggttatatggtcttacttctttgcatgtttaccactatttttttgtatatgggacattgtatataaaagatctgcagaagctccagatttctaccttaaaaagtttcctcttttttaagcagaaagaaggagggctcattccattcagtgattgagctgggttgggactgaatagcagttttagtaagactcagtctatctcctgattcctcgctattcttcaggtgttactttcccaggattttgattgagaacctgggaattccctagctccttagccttgaaagactggggaattgtacttcccttcttcaggggtttgctgctcagctctttagccttcttcctcatgtattatcacaactttgcacctgtgtttaggtggcttgtgtgtttgccacaaacacacaataaaataaagaccccctggtgggtctttatttcttaagcatcatgagactgtgagagatttcagcgtgccttttaagagttttcagcctaactccccagcttcctgtatagctccagaacttggcaaatatcccatgggggaaaaccagctgagtttgagtttctgatttgtcactccagctgtgtgaagctgctaaatcttttttgatttatttttgcctaggtatggccctctgcctgtgtcaagttctattttcactgtagtgccaagaatcagcagattcctacagggaaaaaatatgacgaaatcttcagtttagactagaatggttcttcccttctggaattggattttattagttcctatgactgctatactttgaggatgcttttcttatagtaactttattgagatataattcacataccataatttcacccttttagaagtatacaattcagtattttttaagtgtattcacagagttgtgcagtcatcaccactgtcttcatcacccccaatagaaatcccatacctattaactatcatccctcaatgtcttttccccctcaccactggataccatttattgactttcttctgtctttatagattttcctattctagacatttcatattaatagaatcatataatatgcaacctttgtgtgtggcttctttcacttagcataatgtgttttgttgtttgtttgttttgtttttttgagacggagtctcgctctgttgcctaggctggagtgcagtggtgtgatcttggctcgccacaacctctgcctcctgggttcaagctattctcctgcctcagcctcctgagtagctgggactacaggtgcacaccaccatacacagctaatttttgtatttttagtagagacgtggtttcactatgtcatccaggctggtctcgaattcctgacctcaagtgatctgcccatcttggcctcccaaaatgctgggattacaggtgtgagccactgtgcccaccctatgttttcaaggttcacccatgtggtagcatgtatcagtgcttcattcctttttatggctgaataatattctattgtatggctatattatgtttatccatttatcaattgatgtacttctggattgtttccactttttggctattaggaatgctgctgcaatgaacatttgtatataagtttttgtgtggatacgtgttctctcaggtacaaacctaggagtggaattgttgggtcatatggttaactctgtttaacttgatgaggacctgacagacttttccaaagaggttataccattttacattttcatcagcagtgaatgaaagtttcaatttttccttttaaacacttgttattgtccatctttttcattatacccattctagcaggtgcgaaatggtatctcattatggtgtgatttgcatttttccagtagttgatgatgagcatcttttcttatgctttttggccatttgtatatcttcagagaaatgtctgttcgaatcctttgtccatttttaattggtttcattgtctttttattgttgagtcataagagttcttcgtatattctggatacaagtcctatatgaggtatatgctttgcatgtattttatcccattctttggggttgtcttttcacttcctacttttttttttttttttttttttttttttgcaatggaatcttgctctgttacccaggctggagtgcagtggtgtgattttggctcaccgcaacctctgccaccagtttccagcagtcctcccacctcagcctccagagtgccaggactacaggtgtgtgcccccacacttggctaatttttgtatttttagtagagatgaggtggcatggtttggctgtgtccccacccaaatctcatcttgaattatagttcccataatccccacaggtcatgggagggacccagtaggaggtaattgaatcatgggggcagttaccctcatgctgttcttgtgatagtgagtgagttctcatgagatctgatggttttataaggggcttcccccctttgctctgcacttccgcctgctgccatgtaagacgtgcctttgctcctcctttgccttctgccatgattgtgagtcctccccagccatgtggaactgtgagtctattaagcctctttttctttataaattacccagtctccagtatgtctttattagcagtctgagaacagactaatacaccagccttttttttagttctttagacatgattttcattttttaggtccttgaaaatatttataatagttgatttaaagtatttgtctaggtcgggtacagtggctcacacctgtaatcccagcactttgggaggccgaggtgggtggatcacaaggccaggagatcgagaccatcctggctaacacagtgaaaccccgtctctactaaaaatacaaaaaaaaattgccaggtgtggtggcgggtgcctgtagtcccagctactcgggaggctgaggcaggagaatggcatgaacccgggaggcagagcttgcagtgagccgagatcgcaccactgcactccagcctgggtgacagagcgagcctccatctcaaaaaaaagaaaaaaaaaaattagccaggcgtggtggcatgtgcctataatcccagctacttgggaggctgaggcacaagaatcatttgaacctgggaggcagaggttgcagtgagctgagatcatgccattgcactccagcatgggcaacagagtgagactgtgtcccaaaataaagtatttgtctagtaagtccagtgtctgggcttccttagggacagtttctgtttactgatttttttttcctttgtatggaccatactgtttctttgcatgtctcattttttttttgttgaaaactggacatttaaaaatcatataatggcaactctggaaatcagattcccttctccctagggtttgttgttgttgctggtgctgtttagtgacttttcctcgactaattctgtaaagtctgtgtttctttgttaagagtggccactgaagtctgcttggttagcttaatgtggttagctaatgattgggtagatatttccttaaatgcctggaaccagtgtatctcccagccttggccaagggattttctgtgtgtgttgggacataacttcagtgctccaagaggcagcttgtaagtcaaccttgtgcagagcctcaaggtcagccagagatgaaagattagggtgttctcatgtctttcctggacatgcatgtatacatctgtgcatatgcatgtgaaccgtctagattcccaggaatatgtttgtgtttttcaaagtctcctaggggacatcttatacccagtttttccttttaagctttttggccagcctgttgttagccctgactggtaatattgtctcaggcagctgcaaagttaaacagttgccaccattttcccccgtcagatgccctggagatggggttgttcacacagaacaagctctaatttaggtcaaaaaaagacaaaccctgaaaaggagcttttcagtgagcttcgagactggtctaatagtgatagttctctgggcatggggcttttggagagctccaaacccattgtgccccctccagcgattatcgcatggctgtttttcacacctgctgtagttgtgaagtgttggttttcaaggctactgtgaaaatggggtgagggggattatattagggcaagttaaaatgccacagaatttgctgtttttttctgagatccatccatttttcttaaacactttggattgttgcaagtctttaatttccagagttttgaaaaagatagtttttatagtttttgccagtgttttcattgtttttatgaaggagtagatttttggaggtctttgatcagtcatcctggaagtgcttctctgatgatttaaaaaatactttgtaaattacctggcttttcctagttatctctgtaggaacactttgctcccttagcttactacaatacgcagaagcagaagtcgagtcaattttatatttgtttcagccccagatagtagaccatacccagcttgataaacttttcataaagcatgagtacattacaaataaatgatgaagactttttctaatcttgccgagattctgaggtaaataaacatttatagaaaactatattttagaactcgaatattccatattattaaatgggtatgaaaagccagttatttctttccttagaatttaatgtcttaattgtagaaatatgagatatgttttgcctgttggttttacagtccattattaaaaatgaaactaaagtggtaagagctctactggactcattgggattcactgagtaactagattgagctaaaggttgctcatcataagattttgagaagcatgcctggccctcagccaaaattttgaaccagatgaagtttgactttgatactcattgcaatctttcttctcttttgaggtctactatcagactttttagatttctcttacaccttatttgtccttttagttggaggttaaatcaggatatttgttgatacttagggtataactgataattaaagctgtctttactttcaggatcatgctttacggagtggtcctttaggtagaagtgcatttggttgaatgataagtaagcagtagacttgttttaagggtagctctaggccaggattgttacttaacaaaatggatgttcattatattatatcatttaatttctctgaagttttaactcctctggctcatgggaacaattttctcaggccattttagacacattttaatgggttgcctcactgtcttgtgagatatttagagagatctgataacctcagaataaagaagcctagatatgctccttctggaaatgcttttaactcttgaatattatttcagtgaaaatataaaataggatgaaatagacacatgttattcatgaacatcaaataattgagaagttctcaatgaaggtattgtaggcaaatgatgtagaaacagaagtgtttcatgctgatgatatgaaaatgcttgagtatattagttcgttataacagacaactgttttttctttgaaaacagcaaaagaagatgtaacagaaaggcaaagcaccaaacgatctcctcagcaaactgtaccatatgttgttcctctctctcctaagctccccaaaacaaaggagtatgcgtctgaaggtaaatagcatttacacctcccaggactgggaagaaatgtttctctgctaccacttatgtatactcttggggtggtagtattggaggtagggaggtaaatttgcccaaacaagtttggcagttaggctactacttggacagctttgttgaacccttcattcccttcagaagtggacggctgtcatttctccatagattaaaaaaaaattgtaataacctttttccttcacttttgtattgctaaaaactggcagaaagaagaatagaaaaacctactgcctttctccagagaatgtaactgcccaagtagtaaacaaatgttagaaaccaactgtatgatcatattataacaaatagtaatgaagaactgcatttctaaaaacaaatgcttcagtgaggtgtttatagccttggtggcaagactggcaaatgatagtaagttactatgaaaaatataggtgatatggaatcactttggactgtaggacaatgtccattaatataaatgccaaggaacgccaagtcgggtggatcatctgaggtcaggagttcgagaccagcctggccaacatgatgaaaccctgtctctactaaaaaaaacccaaaagattagccaggcatggtggcaggcgcctgtactcccagctactcgggaggctgaggtaggagaattgcttgaacccaggaggcggaggttgcagtgaaccaagattgcaccactgcaccccagcctgggcaacaagagcaaaactttgtctcaatcaatcagtgtatgcatccataccaaggaggggatagccatgaactttgtgttagagcattgtggttcagtatagcacaagttaagtgaactattgctagggatgagatttttaaccttttagtagtatttgaattgtaagtctattgaagatagcctcctttgtctttttccctgtaggagaaccattgtttgctgggggaagtgccattcccaaagaggagaatctttcagaagattctaagagctcatcactaaattcaggaaattatttgaatcctgcctgtagaaatcctatgtatattcatacttcagtctcccaggatttttctcgaagtgtgccaggcaccacaagttcaccactagttggggacatatcccccaagagcagtccccatgaagttaaattccaaatgcagaggaaaagtgaaggtatgttcaaaaatagtgactctcaatgtgtttgtcttttgccttgagattttcatacctaacagcatcccctgagagtatcacattggagaaagtgctaaaatttgggaggctgagtcctctctttcacatcactgtcaggtcagaccattatggatcctccaatcctcttgacagcacagaactgtctctagggatctggatcaccaaccatgtctctgatagagacttctcagattagtagtgcttgaacagttgtaatttatcatttccttgggtaccgtctggactcacaaacctctcatgactctgaggcctggaaagacagtccctctcctttctgttgtacacttttcttcgtctctcttgagacattcctggcctcagcctgtgttgactcctggattcgggctggcatcttgttaccacagccacaccatttcctcactctccacatccttcctcagacccaccaggaagtcatgacatgtataagtagggcaatatcctgttgccatttagaaagagccagaacaggccaggcgcggggtggctcacacctgtaatcctagcactttgggaggccgaggcaggcagatcacccgaagtcgggagtttgagaccagcctgaccaacgtggagaaaccctgtctctactaaaaatacaaaattagctgagcatggtgatgcatgcctgtaatcccagctacttgggagcccgaggcaggagaatcacttgaacccgggaggcagaggttgcagtgagccgagattgcgccattgcattccagcctaggcaacaggagtgaaactccatctcaaaaagaaagaagaaagaaagaaaggagccaaaacggccttccatgtgcaaagagggctaataccctgtacctttgaaggattaagggtacaggagagtgagggtgggaataagtgttttgtcctttttctccaggtaggcatgcaggcgaggttgaggagtgaaggaagtgggaacccttgcctttgatcatgggtgttatctatgggcaaccacactgtgcacacaccatgacacatttaatgttgtcagccccatcccctctggagattgtctctgcctttagagtgacatagcttgcagagtctaacaatagatgcttactccataatggctagtataccttgcattttaaagtattttcacaaagtatgaccttttggcgataggctttctcagtataaggttacttctaatggtgaatatctcactttgaaatgtatgtcaaacactaaggtagccggtattggggcatcagacggctagcttctggtcttcttagcaatgtagagactaatagtaataacattgctttctagtaatttacttactggtaatagaaataatcatcatcttcatcactatctgatgtatgccagggatataatatttcatatggcctcctacattatattgttacaacaattccttgaaatgtaggtgctggtaagcattttcaggtaagaaatttgaagtcatttggctaaggttcctcagctagaaagtggctgggccagtccttgagctcaaacactctgactccagggttgtactcttaacttctgtactccttgcacctcccaagaatagatacgcatttccattagaaactgtctagaggtgtcattactattatttttaaggcatttgaactgttacctagagctaattccactcctgacagccagtgatgctcacacaatttcctgtcctgccttgtcccattatttgaatgaaaaatattgctgatctttattataggaaagaaatccaatgatgtcgagggggggggatcagatcactttcatactttcattatatttattctagaaatatttattgatatgccagtgtatataagacagagccgttcaggagaaaagcatgactggactttgattatttttcacatgattagtttgtttcatgtaattatttgaataacaataatgtaatgcttgcaaacttctctgattgttttgaagatgtaggcccaattaaattatattttcataatagactaaaaatagaaaatcttatggttttatttttaatataaaattttataccccaaatcatatctttttacatatagtttatttgcagtaaactgtaaaactagttacatgttattcaaaacataaatgtaccagattatgatgacagaaaccagaaattccacaaaaatgtacattaaattagagatatgattagctttgccaatgatttttttcatgttatgttgtgtctttgttaagttaaaggagatggtgtttctgtctaaattgtcagaatgctaacttaggcacagcatggtctacaccatcatcatttttacttgggttgatacagcctagcagaatttctctgtagatatgaccaacatttttttctctgagtggaggggagaatatattttggtatagagtttttatttcacatcatcgttgtgatgttggaaagaaataaaattcagagctacacacaaaaaattaaccactataagttcttttattttctgtttttctttatccttcccctaggtaaatatacttaaaatgcttctaaaatggccatagtccagaggataggaaagaaagggtactcctttggctaattcacacacaaaaaaacatcaaatttgtgttgacagtccttggttagcaaaacaaatcttcctagctaagtacaaaattcacttcagttatccacactaactttagggagttaagggctctggttgagtaaatgaatacttgtcaggacacagattttatcacaacttagtaaagagcacagctaagaccatttgaggtatgagcacttaaattgtttcatgtctcagttatgtatttttttaatgtataaaccttcaaccaaaatatctattactatgcaattaaacatgataaaggagttaaattaaatgttaaagttatttctgacctagcttagcagaaaataatcttgtcttcttcaaaattcagataagcatttaagccatgagagacaggaatctaaagagtaaagtgatgctaaaaatattcttattggatacatcagagagatttggtaaaaggactaatttgtttatcaaaaataatgggattattgaaattctttgattaaagtgaacacatttaagcaattagaaaactaaatttagccaggtatggtggctcatgcctgtaattccagcactttgggggcctgaggtgggcagattgcttgagtccaggagtttgagaccagcctgggcaacatggataaatcctgtctctacaaaaaatataaagattagctgcaagtggtggcatgtgtcagtagtcccagctacttgggaggcaaggtgggaggatcacttgagcctgggaggtcagcgctgcagtgagccatgattgtgccactgcactccagcctgggtaacagagcgagaccctgtctcaaaaaaaccaaaacaacaacaacaacaacaaaacaaaacaaaaactaactgtaaatttggggaatttccatcggatttagctagtaaaatatacctagtctagacagatagagagagattgaaattccttgaaagacttaaagtaagagagaagtcataggttagattagattaacctaattttacccgagtaacagatcttttgctgtatttgtctgtggccaaagaggcttggattgcttagtctgttttgtgatctttgaagctttaaggtaacgtctgaacctgcttttgttgtttgggggaggtcagatgggatgctcttatgtagccatcctcacatcatttttgtataagctttcacagttggagtcttgagaccttgttggggaacttaacaaaaggttccaggaatgagaccattattccctacctaacatctcttctttcaggataatgatcaggtcaagtatgatttgtcttttttcccccccattgaagctccaagttatatagctgtacctgatcccagtgtcctgaaacaaggcttctctaaggacccttcaacctggtctgtggatgaagtgatacagtttatgaaacatacagatcctcagatatcaggccccctcgccgacctcttcaggcaacatgtaatgtatcttttgatccggttttcctgccgtaatgcctttgaatgacctctgtgcaggcccttcatttggatgctgtgtggatggtgggggaaccctatcaactgatttttccatatgtgagagaggttatttttcccaagattagttccttaaatggtagattaatggtctgttctttaagtgagtatccaggtgcctaaaatacaaactgcttcaacttctcaagatacgatgattcagcattgcaactctcaggtgtaccttccctttgtgatgacagatacaaggatcctccccgacctgctcccagctcagtgccagaaccatgagtaggaggggttgaccacaagctattacagggtggccttcctccagtgaatccagcaactttataagattaagtacatccttttaaacaggaactcacaaataccaaataatatgcttccatgacataaattgattaaggtaataaagaattttaggaggatgccttgtgactattaagtaatattttcagtgttttctaacaaatcaaatgagtgatctattatctgaggtacccttttcactatcgcaagaaaatcagtagttttagcatctaaccagcttcagacaactaactgattagccttcaacataatgacaacactgtatagcacatttacagtttgcattgatattgacatattcctggcccttctcagaaagttattgatcatctgaaattcatttctaccattcataatttttgatcttttgtcatagatatatttagtattttatttaacacacagtatttaaagtcagattgtttgatacttgggacattttttgaagatacaagattaaattttcttaaagtttgaactaaattcataaattatcaaatgatgcttcactgtataaattatatttttaatagttttcaggaaataaagcatattcagagaatatatatccggagtatacagctgctgtattttacatgttcttatgtataaataatttgatatgaaagcattattaatgattatgatttccttctctctgtaggaaattgatgggaaggctctgttcctactcaagagtgatgtgatgatgaagtatatggggctgaagctggggccagcattaaagctgtgttactacattgaaaagcttaaagaaggaaaatacagttaaaaaaatgtgtaagtttagattggacataattctcaggtgtactgttaacattttaatttaaaagtatttctcttagcagtttttgttttgtagacagttcccataaaaatattttatcagaattgcagaactgtagtaacagttcagtcaactttgtttttttcctggagtcaccaaccagctttgggagacacagccgccactcccccagtctacttctttaaaaagcatttaacaggttagtattggcatattcaaattggcagttctttatgtctttttaaattttcattgtacagtttacaaatatacttaatgtagttaacagagaaaaacctttgattttggttaacctttatatctagaaccaaaacagctaaatcccaaaggggaaaatatcagggattgacaacttctataattaaatccatgagaatttttcctcactagagaatttaaaggtgcacctgtagatatcatcttttctcagatattttgtgtgatactctgtggtgttctgttcatgttctatcagtatatctagaaagggaatagccatataaattattttccttttattatttctctgtatgttgtatttgatcatatttaaaggaaaaaagcaagcttataagctttcatgaagtgttcttaccagtttttgataaattttttaaattataggatagaattgtcattttatgcaggagatatttatactacgagggttgtttggatggagtcagattaaattttttcagtgaaattcctattattttaaaactttccatattttcactacgcttggacatttaactaggcattcttttcttacatctctatatgaagatacctgtgtccaaaatttttgaagatatatattgtatgtgtttattcttcatatggtactttaccatatttatatattgttttatacctgtaggtttacacacaagtaaatcttttttttcttgaatttaatctggcactttgcactgccacagaggtgacgatgaactatgtatatagttagatgttttgatttcgtaaaaaatatatgtccatcgtttgctatcaccagtacctctcagcttactcttcaggggatatgaaacaatctgtagattggtttccatacagggaagttctctgtcctatgcaatgtttctaattaatttgcttagttctgagccatttattctgctacactttgaaagatatattagttctgacttattgtttggggctttattttatttttatttttttgagatggagtttcactcttgttgcccaggctggagtgcaatagctcgatctcggctcactgcaacctcgcctccctggttcaagcaattctcctgcctcagcgattacaggaatgcaccaccacgcccagctaattttgtagagatggggtttctccatgttggtcaggctggtctcaaactcctgacctcaggtgatccgcccacctcggccttgcaaaatgctgggattacaggcatgagccaccatgcccagccatgtttggggctttattttataagttagaactttgaagaggaaatggtgctatatgtttattgttattactttgtgtaactttgatgtaatgtttataagctatgagaatcagttataaaagtattagccatttgttgtaaatgccaataaaatattcaccaggggcaagaatgtacattttctttttagaaaaccaaatgtactttagacatgaatgcaactatttaaagaatagcttcatttatgttattccttacatgtcataagattcttacttaaacttggtcttctttcaagttgtttgtatgaagatgctgtacccacttgaacagtcctcaggtgtttacataaatactatgttttacagttttcatattttaaaatattaataaagttaatcgcaacgatt

SEQ ID NO: 5527 - DNA, 113418 bp, human
ggcttctcaaacatggcggcggcggtgtgaagctcggtgccggctcgcgcgatcggtgggacagaatttcgttgttttcaccgacgagactggaggtacgtggtgattccgggccccgtaaggaatggagaggcggaggtgtgtcccggaccccgaccgttgtccgtgggcgggcgggtagaagccatcagcgcgcgtcccgtgcgaggaacgcccccttacgatcccgcctatgtcccatctcagttcggcttcgcgatagggtatcccgcccccggcgccttccgcggacgcccttcagccgatctcgcgtttcccctcacgccgccccggggccttttcgccgccgcggggtttgggcgcccggccgatagcttccacccgtcccctcgcctgcagcgccgacagcgccctccggcgcatcctccctgccgtgggtagggccgggctggggcctggggggcatcacggtgggtggcggggcggaggaaggaggtagactttgcctggtctgggctgagataacttttggagtttgggagggaaacgtcggcccggaaggatgcgcctgtggcggcgtgcgggcgcaaatcctggtgccaaggtgcgcgccgccgggctcctggcgggggctgggggcgccggtggctcaccctagcggtgcagcgggaccggaatgcgcgtcccgtccggggctggcggggaggcgaggaggggctctaagcctcctgaggggcggagaggcggcctcgcggcctgaccgaaaaaaagttgctgccgtcacttagaaacagtctcgaaatggtttcttacctttctcgctttttccacctgtatcgtgcttgcgccccatccaggtgtgaagagccggagggagaatgggtctaggcgaatttgctcgattttgcgcctcaaggttgtacatagatagcttcctgggccgacttgtaattcggctcccccaaaccccaaatgtttgggcagcacaagtatttacttacaggctcccatttgagactatttattttttaaaaagaggttgttaaacatttgtcaagcatcacaaagtgtgattgcaacttgaaatttgcttcttgtttgtaaattaggagattaacgtttatgacttactttaggtcttctctggaaagttaatggatcgattagtgggggtaaactgaggcagggaaagtgaataagttgcttatgatcatatgatttacaaaagtattggagatagttgtttttttccctaaaacagcttcagatgctgctacattttaatgcccccagagctattcatatttctgttttgagggaaaagtattttaagatgtacaacatttatggagtacagctgcctatgatgagcaattgttttataacaatggttcataaacgcatatttaattcttttcaataacagcgagggaaatgtttttcaataatgacgattttgcctttcttttatttttcttaattactcattaaataaaatatttccaattacgaatgtgctttcaggctgtttgtgtgttttttttttttttttctatttaatgggaggaatgtgaaaataagcttttggaaatgaatccagtgggatttttgagaaaagattgagtttatgagtattcacctgatgccttgtgtttagctttatctataacctttaaaacagtttgatagaatgtaaagaaaaaacaccatttaaactggctttgaaagttttgaatgaactttatatatacatcatgcagccatatgaacttcttaaggatgtatacttgtttaccccagagaacctgatttgctttggaattggtagttggaaaaaagattactgtaactctactgcattatatgtgcgggtgctttaaagttgatagtgtcataacgttcaaaaatcattacagtcagtctaaaaaaggtgtatcagtttttctcatgaggtggttgatcagtccttttgatttatgattccatcaacacatctttattaagcacctgtgctgtctttactatggagttcagtttattcagagcccactacgtgtgctaatttcagggtgtttaaggctttccacccatagtttattcctgaaaatttcagggagttatagctaaaaaaatcaatacgaatgtagaacaagtattcctttcattcaaagggcgaactcgagaagtcagtatttttgtcataattctccaaacaaaattctgagtgtagctgcaaactatttctgacttacgtgatgttaactttgtgattttttggttaggattatataaagctatatattttcatgagattattttctggttcaaatagataacatactggttaagcttgaggggaaaaatgagttgctggtataaatggaaatcaatatgtgctctgaagattgggtattttttaatactaagcaatttctattactaagtagtttaagctgtaattaagttttaactggtattttaaagcactttgttttttcaaaatgttgcagaaatctctgagctcagaaataacaaataagggttatgatcctcagctataagccagatgtgactcttattttcttttgggcttgttcctttttagctgcctgcctgttcctcccagatgcttcctatcacccctcttcctgcccctgttccctttgctgttggtgtctgtttccgcatcagtgaaatggtcagggtaatcctttgctgcttcactgagaaataattaatgatggtaaagtgccttgaaaaggctgagtaaataccaagtcttttgaattaacttgatgtagccacttgttccatttaaggaagagccaaatcccaattttagtttgagctcttgggggtgcgagagaaaagtttcacttgactattttactgcctttcttttggggttaatagcaatgacttttgtaactctagtaactggaacacgggtggatacagcagtatcctctgctgtttgccttattagtcacctctagtcttttttttttttttgcctggttattctgtctgccatttttctccctctattctcattccacttgtgaatggaaatcggaggtcctctctattagctaccctctcggggtggggagggtaggtctcactgtctcctcatagtcatattcctgatttttaggatatacaagaacaaagtgggctctgccagctatcagccttagagctatgagctgtggtgcaaagattagtctgtcattgccagaaggtgttttgtagtttgcagtgggcaaatcaagcatccctaataattttagaaccattattaatgtctgagaattactacataataccttagaatttgaactgattgttgattccaggaactaaaaacctggacattttgaaaatggcaaatgttggtgatgtttttttttttttgagatgggctctcgctgtgttgcccaggctgtagtgcagtggcgtgatctcagcccactgcagcttctgcttcctgcgttcaagcaattttcccacctcagcctcctgagtagttaggattacaggggtgtgccaccatgcccagctaatttttgcatttttagtagagacggggtttcacctagttggccaggctggtctcaaaactcctgacctcaggtgatcctcctgccttggcctcccaaagtgctgggattacaggtgtgagccaccacgcccggccgtgttggtaattttgaaggaagagtttatacccttccctggctttggggcttaatattcaggatctctttgtcttggggaaatagataaaagaaaccactggcgtttatcttagattaaaatggcataatttataccattatataaatactggtataatttagtggtaagtacattttttagactctaagtaccttaggctttggttaccatttataaaaagagtttgtggtagttctttttttgatacggagtcttgctctgttacccaggctggagtgcaggtgcaatctcggctcattgcaacctctgcctcctggcttcaagcaattctcctgcctcagccttcccagttgctgggactacaggcatgtaccgccacacccagctaattttttttttttttttttccgagatggagtctcgttttgtcacccaggctggagtagagtggcacgatctcagctcactgcaacctctgcctcccaggttcaagtgattctcctgcctcagcctcccaagtagctgggactacaggcgtgcgccaccgagcctggctaatttttgtatttttagtagagatggggttttaccatgttggccaggctggtctcaaactcctgacctcaggtaatccatccacttctgctgcctctccaagtgctgggattacaggcatgagccaccgaatctggcctttgttttttttgagagtcttgctctgtctgttgcccaggctggagtgcggtggtgtgatcttggctcactacagcctctgcctcctgggttcaagcaattcttgtgcctcagcccctgagtagctgggattacaggcgtgcatcaccatgcccactaatttttgtatttttcataatttttgtatttttagtagagatggggtttcaccatgttggccaggctgttctcgaattcctggcctcaagtgatcctcctgccttggcttcctgaagttctgggattacaggcgtgagccacctcgccctgccaatggtggttcttaaaaataacttgaaaaaattttagaagctatcaagatttgaaatgtgtatgtgttctttggttttcatgagaaaggcgattttgtttattttgtcattatgttgtctatttctagggttaccttggcaaccttagaaataatactgggtttttttttgtttgtttttttttgagacggagtctcgctctgttgcccaggctgtagtgcagtggcacaatcctggctcactgcaacccccacctccgaggttcaagtgattctcttgcctcagcctcctggggagctgggattacaggcgtgcgcaaccatgcccagctaattttttaaaaaataattttagtagggacggggtttcaccatgttgttcaggctggtctcaaacttctaacctcaagtgatccacctgccttggcctcccaaagtgctgggattacaggcgtgagccaccacgcccagcctggagaggtgttaacataagcaatggagatatcttattgtgtgaaaagtgaaatatttgaggatcctgtagcagtgaatatgatggtgctgttcatcttaatatcatgatcatttgacctagactacatgaattccttatttgaagagttaaaacttatagaataagctgtgagtaaagacctgggaaactgaagatagcatttgattacctactacttgtgacctgtgtttatggctatggctctgcctcttcctaagtttataggagcaaattgttttaagaggggaaagagagtgcccacttttagtggtaacgtactgttgtaaacttcagaagggacagatatattacaattctagggcataccttgaagatgctttcatttctcagagaaaagtttgcggggctctctttggttgtgtttagaatacacatttgatttttcgcaacctctgtttctcataaagattaactggtggcgaattatagacaaacagctccatttgtttggtatgtaccttatagccttgacatagttttttaagtgtattgacaaagtgcttgttttttttggttaacatttggccacttttcctacctttcatcagttttagctggtttaaggtttgattatatatttatttttaaatgctgaatcaaatgtgtttcttcttttcagttctcttcctctttgaatacatttggaaacatgtgccctttgctatgaactgttgcttttttttctttggaaatattttttaaaatgttatttggagtatttttctctttaatgttatttgaaaagcaatatagtcagtattaatttttaactaacttgatagagtttcataaatctgttcaaatgaaacacggcatctttggtcattaaaagaattaatatatagtaggcaatagtaagtatatttagatattgtttggttttagattactttagagactctgatttgagattttttttgtgttgaaatttgagaagttgtagaaatatttgaatgggtaatttgctgacacctgcctcatgtttgaggtattttcaaggatgtttagttttctggtttcttcagattgtggtttattgcatgcttttctgcagtctgttgtctagtggggattgttgttgtcatcatttccattatttcttgtagggccggtgttagaaaccataaatctagactgcagtgataataggaacagcctgtaaccagatccagttcttttgtcaaaaagttgcaccattagctgcctgtagtatattgacatgccctgccattaactcaagtccttcacaaaagtcagtgggtagcaggtctttgggcagttagcctgtagctgtgctttaaaacctcaggaatttacaactataaactgggattttggcaacccttgacttatctttcgtttatctgttttctgacatgacatacttcttcactaaatacatagctttcacataaatcattttgaaattgcaagtgattaacttacaggttttttggggggtaacttaaattagaaatttttgaaaatagttaagccttcttaggtttgttttgacacagaaaaagattaattactaatttgttggggtggactctttactaaagcataatttaaaattgctcctttagaaaccttaatttcctcaagaaggcttgatttgataaattattgctaccaaaaatgttctttgatttttttttacagatttcagaaatatggagatgaaaatgttctttttttttttttttttttttttttttttgagacggagtcttgctctgtcacccaggctggagtgcagtggcatgatctcggttcactgcagcctctgcctcccaggttcaagcaattttcatgcctcagccacccgggtaggtgagattataggtgtgtaccaccgcagacggggttttgccatgttggccaggctggtctcgaacttcagacctcaagtgatctgcccacctcgtattcccagagtgcggggattacaggcatgagcccctgcgcccggcctaaaaatgttctttttttttttttgaaatggaattttactcttgtcactcaggctggggtgcaatggcactatcttggctcactgcaacctccccctcccagattcaagcgattctcctgtctcagcctgccaggtagctgggactacaggtgcccgccaccacacccggctaatttttgtatttttggtagagacggggttttaccatgttggccagtctggtctcaaactcttgacctcaggtgattcacccgcctcagcctcccaaagtgctgggattacaagcttgagccaccgcacccggcttgttctttcttaatattgattagtcttaattcagagatagaattttagttttaaatgtaattacagtattagaatttagtgtttttctgattacttttataactatgtcagaaaatgtgacatttgattatttacttgagtgaattgaatagatacttgtggaatcttaatgtgatgactcatgttcaattccacaaaattatgtatggttatacaatggaatatacactttttctatcctgtattaggataatcactattaccagaaacaaaatcttagttgaaagagagagcttctcttggtcaaagaaaaaatacataactacagtgtattttaattaaatcagtatttttttttgcatttaggcataaatgtgaagtacttcttgaaacaaaataataaactatttacaagttaaaaacataaaggtgttattttatgcagttaactcagaccttccccttcacaataaaggacagcgtttttgtttgttcaagtctaaaagtagtgtctttataacaagatagattttaaaaggaaaagaaccctttctacctgtgctatttaattaatctctggtaaattgtgtatgtataataacttccgtcacttattccaacattttctttaaaacaccagcaaacgtatttgtgaatctctcttatccttgaaacttcttatgctgttgataaactcaaggggctatgatgaaacatttttttcaatagattattttgtgaatagggacttggcttgttgtttctttttttggtgaatattggtttaaagcacatgttttagttatacctgttatgtagttggcatttataaactgaattctataatggtaactcatacggagcctgactttttgagaccatgaacatcctagaaagagataaaattcagagtaaaaaaaaaaggccaatcaacttctgggaaagagagagatattggaggtgggggattgtctcagatctcacagaattttctccttggcccattgacttagacttgtgtgtaaattaagacagctgatttgatattgcaggaaagaacagagaacaacaatgatggccaaaagaaaaatctcggccgagcgccgtggcttacgtgagcctgtaatcccggcactttgggaggctgaggcaggaggatcatttgagctcaggagtttgagaccagtatgggcaacttagtgagccatcgtctctactaaaattaaaaaaaaaaaaaaaattagttgctgagcttgttggcacatgcctatagtcccagctactttgtgtgtgtgtgtgtcgggggtagggggtgtgcagggggtgtgctgaggcaggacaatcacttaaggccgggaggtcaggctgcagtgagccctgattatgccactgaactccagcctgggcaacagagtgagaccctgtctcaaaacaaagaataaaagaaaaattttatcaaaaaattgttttagtccatgtgtggtggcttacacctctaattccagcactttgagaggctgaggcaagaggattcattgagcccaggagtttgagaccagcctgggcaacatggaaaaactctgtcactacaaaaaatacaaaaattagccaggtatggtggtgtgtgcctgtagtcccagctactagggagggtgaggtgggaggatcacctgagcccggggaggttgaggttgtagcgagctatgatcactccactgcactccagcctgggtgacagagagaccctgtttcaaaaaaaaaattgtttttaaaaaccacagtattctggttctatatagtttagatacaagcagcctatagcacagcagagtttactcattcagcaaacattttggggaccctagtatgtgatagacactgtgctcgttattctgaaggatataaagaagaacgagatgtgatactgcccccaggagcttattgtctagcacgggagaaaaggcacttacacagttaaacacaacaaaggcagttttagcacaatggttaagcattcatgaacctagattcaaacctagctgggtgatcttgggcaggtctttgagcctcaatatccttaactttcaaatgaacattaatggacattaataacagtatctactatgcaggcttgtaataagctttagataagaaaaaatacatatataaaagccttagggtagggtaccaggcattcattaatagcaagagctcagtaagtaacagatctgagtagtagtatcaccactgccaacaccattatcattgaatctctgggaacataacttttgttttctcctgccctcatggatccgttttgtctagggtatctggtatattataatatctccttgtattagtctgttttcacgctgccgataaagacatacctgaaactgggcaatttataagaaaaagaggtttaatggacttacagttctacctagctagggaggcctcacaatcatggtgaaaggcatgtcttacagggcagcagatgagagaatgagagccaggtgaaaggcgtttctctttataaaaccatcagatctcctgagacttattcactaccatgagaacagtgtgggagaaaccaccctcatgattcatttatctcccaccggttccctcccacaacatgagggaattatgagagctacaattgaagatgagatttgggtagggacaccaaaccatatcactccttatttctccctttcaaagcacatacggtgtattggagccttgtcttttggcatttgacaaacctcgatttgaatcatttttctttcactaccagcttcctgatcttgaggaatcaaaataacttggtaactgataagacagaagaggaggggagtcaaagatgacttctaattcagaaagattgagggtttgtaatgcttttaaaataaaatgcagaggaagaggagctcattttggatggcaagaatttggttatttatgtatttattattttattattttttttttagagacagggtctcactatgttgcccgggctggtcttgaacttctgggctcaagcgatcctcctgccttggcctcccaaagtgccggcattacgggcatgagccactgcacctggtcttttaaaaaaatttttattttttaagtttcccacaagtcatagggaatgagagtttggtttcgtagttttattttattattttttcttttcttttcttttctttctttctttttttttttttttttttaaatagaggcagggtttcactgtgttgttcaggctggtctcgaactcctgagctcaagcagtcctcttgcctcagcctcccatagtgctgggattacaggtgtgattgtaatccggcccaggtttttttttccttttctttttctttttttttttttttttttgagacagagtctcgctctgtcgcccaggctggactgcagtggcgccatctctgctcactgcaacctccgcctcccgggtacaagcagttctccctgcctcaacctcctgagtagctgggattacaggcgcccgccaccacacctggctaatttttgtattttttagtagagacggggttttgccatgttggccaggatggtcttgatctcctgacctcgtgatccacctgcgttggcctcccaaaatgctgtgttacaggcgtgaaccactgcacctgtccgtattttattgattcttatgttctctcaggttgaaattctacagttgtattcattttataacatctgaccaatggcctaaagttgaaacaggccttgggaaatctctctctctctctcttttttttttccctagtgaaattgaactgaacctggaacctgggatatttcttgctgtcagatttattcagttcctgtccttgtcaaaatgtttacccttactgaagatcactactcttcaggtagtgatctttagagactcaaggtgtagcttaccttatcttaaaaacaaaacaaaataaaaaaaaaagggaggtggggcacacgaaaggaaaaaaataaaaaataaaaaagagaaaagaaaaagaaaaaaactctccaaacaaaaaaccccagaaaataaacaaataatggaaaggccctataatcttagaattatagacccattagtttgttaaatagtactttaaaactgtttttctcaacagattgtagaattttctccagaatcagataagagtaatgggagttttaggcttaataattccactattaatcactgtttacattgtttaattgtgttgagaaaatggtttaaaacaagacttttcaaagcatttgttgatcttttatcagctcttaattctgtaacaagatacaatctgcaaaacaaatggttgtgtaaaagattgcagattgtccatacttgttcagagcttctagatgcaactgctagatttagtataactgtagtctttttttttttttttgagatggagtcttgctctgttgcccaggctggagttcagtggcatgatctcggctcactacaacctccacctcctgggttcaagcaattctactgcctcagcctcctgagtagctgagcttacaggcactcaccaccatgcctggctaagttttgtatttttggtagagatggggtttcaccatgttggccaggctggccttgaactcctgacctcaggtgatctgcccgccttggtctcccaaagtgctgggattacaggcgtgagccactgcgcccggcccaactgtagtcttttggtaagtgaaatttcaatgtcaggcgctatgaaatactattaacctaaccttttttttttttttaaggcttacttacatttgaatgttttttcacacagtggaattgctcctaatatgcattaagtgaagcaacttctactctttatgttgccaaaaacaaaaacaaaagcctgaagcttttaactttttttaaaaccaaaaatttttctcccatgtatcaaggcaagttacttgagggtcttttttgagcctttcttataatgctgaagcaggttcaaagtatattgaaagcaaagataagcttttttgcagttttccttgcagactaccactgtggaaatgtgtttctaaaagaacttcaggcttctaatttttcccagaaagagctgtgctgtctgcatctattgccaccatatttttctatttgagacactctgaggattcaactaagaatccgttgatgctatccagcatttaccaatagattatagtactcttctcttccctttacatctataatctccatccttgtgactgaaagacaggtgagttacagtgtaatgcattttaagagggacaatagaacgttttattttttctcaagttatagtcaaagatagtttctattaaattagtcaatattcttttacatcaggatcttcgcagattcttcctagtattcagtcctagggaaatgtttgtcttttttttttctgaatttgtgtgtatataacccaagtgttttcctttttgcttttatctactaggaagcccagagggaattactaaatttttcccaactaactagtacatttttattttattttattttttgccatgagctgtgttttcattattcacgcaaataattttctataatatcccagggcaaaccagagaatttggcagtctgattggacccatagggaccctcaggctggtggcatcagcacggagtgcccaggttcacgtcacagtttgtggcttgtgtccatcttgtggtgattcttcctccacattactactggggtctcgaagatgacaggggtagggaatcctccaggctcttaggaaatttcacccgcttctcctgctcaatggcctctttggtcagcagggtgttctcctgcatctctgttttcttcagcttggccttattgaagctggcgatttcccctatgtctggtttgtctgccattttcttaaaacaatcctagtgggcaaaccaaggctcttggcctggggctggggaccagtgctcccttccgcattccctgccagtgcctctcaccatggcactcctgctggcagccccaaggcctaggtatttgctcttattaattcgaacaaacaaataaaactttaccctaagtgtatttttatattgggactgctaatccttttttaaaaacaacaaagtataagatacaaaaattatataggaaatgatgaaaagttttggtgatcaaacattatcaaaaagcagtatttgataaatatagttatgaacttaaaaattatgctaagagtctagtaaatagattttcatctgccttattgtttatcacattttatttatttatttaatttttttttttttttttgagacggagtcttgctctgtcacccaggctggagtgcagtggaatgatcttggctcactgcagcctctgtctcctgggttcaagcaattctcctgcctcagcctcctgagtagctgggattacaggtgcctgccatcacgtctggctaatttttgtatttctagtagagatggggtttcaccatgttggccagactggtcttgaactcctgaccccaagtgatctgcccgccgtggcctcccaaagtgctgggattacaggcgtgagccaccacatccggccttgtttatcacatgttagattgcaaaataagcagtaacttctgtcctgagcgtcaatcttaagaatagcggagattttccttaaggaattaactttttacattttatgtattaatttttgagacagggtctcactctgttgcgcaagctggagtgcagtggtgtgatctcagcttactgcaacctctgcctcccaggctcaagcgatcctcccaacttcctgagtagctgggagtgcaggtgtgtgccaccatggcttgctaagttttgtatttttttgtagagatgggtttcactgtgccgcccaggctggtctggaacgcctgagttcaagcaatcctcccaccttgcctctcagagtgctgggattacaggtgtgagccactgtgtccagcctttggtatgaactggcatttattattcattgtacatttcattttagctaagaaatgttggctttatgaatttattatatagagagaatttcatttgaagattatcgatatatggaatttggtggtatatatttaaaagtggttcaaatatatgttgtatatgggtttacatatatgattttttaaaatttgaagggtgtacaccagatggttaacaacaggtattgtttggtggtggagttataggtgattctttcccccttctttttgcttatctgtgttctcatttattttcaatgatgatgaatgtgtaaaaagaaaaagaaaattctggtttctaggagtccacaaggatgttttggctcataaagggccaaaagccaccttctcttctttttaatttaatttttatttttagagctggggtctcactctgttgcctaggctggagtgaagtggtggtgtgatcataactcactgcagccttgaactcatgggctcaagtgatcctccctcctcagcctcccaggtagctgggactgtaggtgtgctgtaccacgcccggctaattattttattttatttttctgtagtgatggtgtcttgctgtgttgtccaggctggtgccaaatttctggcctcaagtgatcctcctactttgacctcctaaagtgctgggattatggcatgcaccatggtgcccggcccaaaagctattttcaatactcacctaccttaaaggaaataatatattaatgaataattacctaaaagtcatacagcatgagatgatgtcaagtttcctttggctttagctagaatgtataacttttctgataatgctgattagtagatgacagctgctttctttgatagtgatatgtctggttgttataaatatatacatttatttatttcagcttaatataagagcaatttaatttagagttcctgttttgttaagcaacaactctttggtctgtactttggaagagtaaccaagtaatgcttggaaatccaagttggaacatagtttcattttacaacatgattaatgttaaatgttaatgctaaaactcactaatttcaggaagttttcattaggacagatggaatgggataaggaacagtctttgagcttctacttgtttgagatactatgctgggtgttcctacactgcctcattttcttttctttctttttttttttttttaatgagacagggtcaccacacactgtcacctgggctggagtgcagtggcacgatcatgactcactgcagcctcgacttcccaggctcaggtgattctcctacctcagcctcccaagtagctgggactacaggcatgtgccaccacacccagctaatttttgtatttttttgtagagacggggttttgccatgttgcccaggctggtctccaacccctgggctcaagcaatcctcctgccttggccttcccaagtgctggaattatagatgtgagccaccacacccagcccctcctgtctaacctaaactttttacactttgaccaactccccattccttgccccttcctccccagcctctggtaatcatcattctgctctgtacttctgtgagttcaactattttagattgcacatgtaaatgagatcatacagtttgtgcctggattgttttttttttttcttttttttttttttaagacagagtctccctttgttgcccaggctggagtgcactggcgcaatcttggctcacttaagcctgtgcctcccaggttcgagcaattctcctgcatcagcctcccgagtacctgggactacaggcatgtgccaccatgcccggctaatttttgaatttttagtagagatggggtttcaccatgttggccaggctggtctcgagttcctggcctcaaatgatcctaccgccttggcctcccaaagtgctgggattacaggcgtgagccaccgtgcctggccctttcatcttttctaatatatgcattcaatgttgtaaatttccttctaagtactgctttcattgcaatggacaaattttgataaggtgtattttcattttcatttagttgaattaaaaaaaattatcttgagctttcttctttgacccatgcattatttcagagtgtgttgattaatctccaaatatttgggagtttttcagctttctgttattgatttctagtttaattccattgtggtctaagaactgaaacattgtatggtttctattcttttaagtgtgttaaggtgtgttttatggcccagaatatggtctatctcagtgaatgttccatgtgagcttgagaggaatgtgtattctgctcttgttggatgaagtagtctctagatgtcaattatatccaactgatgatgttgagttcaactatgtcctcgccgattttctgcctgctagatctgtccatttctgatagaggcttgttgaagtctcctactataatagtggatttatctatttcttttttagttctatcggtttctgcctcacatattttgatgctctcttgttaggcatatacacataaaggattgtcatatcttttttgagtattgacccctttatcattatgtaatgcccggctttatccttgataactttccttgctctcaagtctgctctgtccgaaattagtatagctattcctctattcctgcttttttttgattagtattagcatggactttctccatccctttacttgtagtttatatgtgtctttatatttaaagtttttttttttttttttgtagccaacatacaattggttgttttttttttttttttttttttttttttgagacagagtcttgctctgtcgcccaggccggagtgcagtgagtggcgcgttcttggctcactgcaacctccacctcccatgttcaagtgattcttctgtctcagcctcccaagtagctgtgactacaggcacacatcaccacatctggctaagttttgtatttttagtagagctggggtttcaccatgttggccaggctggtctcggactcctgacctcaggtgatccacccgccttggcctcccaaagtgctgggattacaggcacccagcctaaagtaattcttgatatagttggattaataactactgtatttattgctgttttctgtttgcccttgttttttattcttatttttgttttctacattttctgccctttgtggttttagttgaccatttaatatgattcagttttttctcctttgtaagcatattattcttttttttcccacttttttttagcggttgccctaaaatttgcgatatacatttacaacgaatctaagtctgcttttaagtaacaggaccattcttttcttattttattttatttattattttttttcgagacggagtctcgctctgtcgcccaggctggagtgcagtggcgtgatcttggctcactgcaaactccgcctcccgggttcacatcattctcctgcctcagcctccagagtagctgggactacaggcgcccgccaccatgcccggctgattttttgtattttttagtagagacggggtttcaccgttttagctaggatggtcttgtactcctgacctcgtgatccccccgcctcggcctccaaaagtgctgggattacaggcatgagctaccgtgcctggccattttttttttttttttgagaccgagtctcgctctttcgccaggctggagtgcagtggcatgatctcggctcattgcaacctccgcctcctgggttcaagtgctcctcctgcctcagcctcccaagtagctgggactacaggtgcatgccaccacgcccagctaatttttgtatttttagtagagacggggtttcaccatgttggccaggatggtctcgatctcttgacttcatgatctgcctcggcctcccaaagtgctgggattgcaggcatgagccaccatgcccgccaatgggatcattcttttaaaaatatttttctttttcccattggattaccttgttccctgagttgaaaatcaattgaccaaatatttgtgggtctatttccggactgcctagcctgtttccactgatctaatttgtatatcctatgccaatgtcacacagttttgaataccgttgccttatactatgtcttgaaataagatgatgtaaattctccatctttgttctttttgaagattgttttagctattctaatcttctccattttcaaaaatataaattttagaatcagcatatttctctgaagaccctatgaggattttgatgatcagtttgttggttctgcagattaatttggggagaattgacatcttaagaatattgagtcttccagcttgtgaatatggtgatttatttaggttttcttcaagtatgtattttcgatcatctgtatacgtattttcactccttccaggattacaaaaataacttattcagccaatggaagcaattgctaccagctgagttaagcattcagctatgggttagatatttgagagaacatgggaacctggttatatcttctgtgtgtgacccatccctcagtttattggactgaattcatttgtatagtaataagactatttatttatttatttttttgaggcagggtctcactctgactcccagggtggagtacagtggcacaatcacagcttactgcagcctggatttcccgggctcaggtgattttcccacctcagcctcctgaatagctgagactacaggcatgtaccaccacacctggctaatttttaaattttttgtagagatagagtttcaccatgttgcccaggctggtctcgaacccctgggctcaagtgatccacccacctcggcttcccaaagtgctgggattacaggcatgagccactgtgcccagcctgataagactcattttaatgtaattcacaggtttttgctctttgatgagagtcggtaagtaccttcacttactacctggattacagtgctttatcatctgtgtggattcaacaccccgtatatattttactttcttgtctgtttctttagccactgggctatagtctttaattgatcagtgtctctgatgctgagtgtcccaggctgatcttgaactgctgggctcaagaaatccacccgccttggcctcccaaagtgctaggattacaggcatgagccactgcacccagcctatgaatgtattcttcataggtttactttaagtgccagattaccttcagttatacacatcatcatgttcttattacaggcacatggagtaatggcgggatagatagccttttgccatattaggtttatccatgtacatatttttttatagcacttatattgtgttttgttcatatgcttatttctgactagactggggtcttggaggccaaggacagcctgttatttatctttgctgcagaatgtctggcatattgaggacatgcaggaaaagtttgaattaatgaattatagctcaaaatacacaaggcttctaacaaataattcttgttagacttgactcttgcagttcttacaggttttcccaacacggtcataattcttgtacctcttggcaacatgatgtagcagaagtgggcttcctggaataggcctcagtttgaatcctaactttgctaacctaccaactgttcttttttactcaattaattttaaaaattgagtcaaaatttgcataccataaaactcacccttttaaggtatacaattcaatgatttttagtattttcacaacaaggcgtataaccatcaccactatctaattctaggacactttcattatcccacaaaggaaacttcatacccatattcatgccccttagcagtcactcctcaattccttcttcctccattcccaggcaactaggcatatacaaatcttatcatttttgtttaagggaaacagattaaattgatctggccttataactgacttcttatccttcagaaatctaatatgctaaaaggaggcattaattggtttttctccttgtaggaaacaacaccaaatagggataccatgggacaaacagtgaatgaaggtaagatttacttgttaaaggcaataatgtttttagttactcatttggaatgaatatcttctggtatactgaacttttgaaataaagcctttaaaaaataaatttataggagatgctaggtgcttagaatttgaattttagaactgaatagctattaaaggtcattgtctttccttgctagttatataaatgagaaaactgaaacttagagaggttaaggtcatacaacagtttgtgacaaagccaagattagaatccaaagagtgattaaaaaatgtttcatcctgttttgctctatgagaagtctgctcactattccatgaatatgccacactcatttgcagtcagctttgtgttgtatcttccttcccataatacattctttacatattggccttcctacatcctgtttctccttcaagcgctgtatctctcatgacttttcctctggctgaatgctgagtactaaatgctgttctctaattttaagtgtatcagtttagtgtagtctcttgactagattcttagcttctctagaagctaagcatgcctttacagttttactttgttttcttttagaaaaatccttctgtagaactatttagtaaatacaaatttgtacgttctttgtacagattcaagtttggctttttggtgagagaggagaggataagatgacttcataagtggtgttgtgtatttctcacaggagactcctaatatctagttatctctctctgtctttttttaaatttttatttttatttttttttgagacagggttttgctctgttgtccaggctggagggcagtggcacgatcatggctcattgcaatctctgcctcctgggcttaagtgatcctcttgccttagcctcctgagaggctggggccacagacgtgagctaccacacctggctaattttttgtatttttagtagagacagggttttgccatgttggccaggctgctttcgaactcctgacctcaagtgatcttcccgcctcggcctctcaaagtgctgggattacaggcatgaaccaacgtgcctggcctttttttaaaaaatatttttttacagagatgaaattactcagactagagtgcagtggcgtaatcatagcttactgtaaccccaaactcctgggctcaagtgatcctcctgccttggcctcccaagcaggtgaggctgcagatgtgtgccaccacacctggctaattttttaaaaaaatttttgtggagactgggtcttgctgtgttgctcaggttggcctcaaactcctggcctcaagtgatcctccctccttggcctcccaaagtggtgggattacaggtgtgagctgtcacatccaacctagttatctctttttgtgatgtgaaaaatcacaaaaagtcatggatggctattccctggatccattcatttattagtagttgtaaaatgaaggtattctatcattctttattggccaaaaaatttctatatagagaaactacctttcttcaaccactcagttgaaatcatttaaacagaaagcagctcatatatccctctcaagtgttcacacatcttgaagagtcactcagtcataactagtaagtagatctgttacgttgaatggcatcattcttagatccttctttaagaagtttgtcacttgacaattagaacatcggtaagggtaaaatagcaacacaagtatgtttaaatccatgagttcataatgataataaaaagcaaaacaaataaaacttactggtcatctgtggagaatgctagagatccagctcatcactttgaaaactagaaatacaggaaaataataaagtgctgattgtgatttctctatgtgatccgtgccttaaggtaactgaatggttgaagcatggaagcttctctctatagaagttttctggctaataaagaatgatagaattagaataccttcattttgcaaccattaataaacgaaaggatctaggcaatagccatccacgactgttcacatcacgaaaagagagataactagatattaggagcctcctgtgagaaatacacaacaccacctatgaagtcatcttatcctctcctctcccaccaaaaagccaatcttaaatctgaccaaactcttctggattgaaatatgaatgccaatttaaagaaaatacaagaaacagaggaaccgaactctgtggggaggtagtcagcaaaatccagactggaaaacttgaaaggaccaaccaactggtattgtcagcaaaaaaattgtaaaggggaagaataaaaacgagaagaaaggaggaagacacctgtagatcaaaagagatgtaagagacatatcaaccattgctatgtgtgtggacttatttgggttctgaatcaagcatacacactaaaaatagttaagacaattggggaacactggttatttgatgattttaaggaattatggttaatttttttagatgtaatagaaatattatgcttaagtttttaaaaatgagtccttttagagatacatactataatacatgtggatgaaatgatacatcttagatttggtgaggttaccaggtccagtgttatttgagctctttagcttagcaccaagaaaatctctgcccagtccattgaattacagtgtattgtagcttctctgttatgttttgaactctcaaaagcatctgttttatttctaggacatgttaatttaaacattgtaaagatcagctcattttgatttattgatgcactgatttttttttttttttttttttttttttttttgagacggagtctcgctctgtcacccaggctggagtgcaatggcacgatctcagctcactgcaacctctgcctcccgggttcaagtgattctcttgtctcagctgcccgagtagctgggattacaggtgcccgccaccatgcctggctaattttttctatttttaggagagacagggtttcgcatgttggcctggctggtctcaaactcgtgacctcatgtgatctgcctgccttggcctcctcaagtgctggaattacaggcgtgagccaccacgcctggcctgatgcattgatttaacaaatgcttgagagtgttgcgatgccaggtcctgttttaggcgcttgaggataccacagtgaatgagatagacaataaaataaataaatctctgcccttttggagatttcatttgagtagagtgagacaataaatgagcagattataaaatgcatagtacattagaaaatggtaagtcctacatagaaaatgaagatattataaaactaaaattggctctttaaagttttttaatttatatttttctgagtgctctttcaagctgttgctgtggactcccagtattgctattttcttttttattagattccatggatgtcaagaaggagaatcaagagaaaactcctcagtcaagtacatcttctgtacaaaggggtaggttttaaagtaatttaatacagcatagttttcttcctcactagtgttaaaattaactttaagtgcaaattttcttattgttttgatttcttattgtacagtctgtatactgtaaacttctgtaaatacaaaatgtaataagaaaggtcaaaaattgtattttattttgaaaattttacttagagataagttgacacggattaagtaaaagggtaactttgtatatttcagtgcaaattttcctaaattataggtatctagttattaattgccatgtattaccaatttaaaataatttggttattagcaaaaacccttctaacgttacagtcaatgtgaaagcttttttttcatggtcagaagacagttcagtggttaagagcttataggcattgtggtgagtccgacagatgtgttctggaattctgtcctcactccttactggccatggtgaccttgggcacattactcaacagctcttagacgttttttcttcttctttctttgagacagagtctcgctgtgtcacccaggctggagtgcagtggtgtgatcttggctcactgcaacctccaccttccgggttcaagcgatttttgtgcctcagcctcccgagtagctgggactacaggcatgcaccaccacgcctggctagtttttgtatttttagtagacatggggtttcactgtgctggctaggctggtctcaaacctctgacttcaggtgatccacttgcctcaacctcccaaaatgctgggattacaggcgtgagccactgtgcccggctcttttttcttctttataacacagggataatgatagtacttatctcatggcactactggaaataaatagaggaaatgaatttaaagcacctaatataatgcctaggcatatagtaagtgttcagtaaatgttaactttattaattcatgttccttattatgaacagtacatgtataatattgcatcagagacactcaggagatgtaatagaatctgatgcattggcttgctcttaaatgagaaaataagtcatatgtacacaaaaggcattaaaaaataacgtagcaaactattgttttaccagacatttccagagatttcttgccccttgtgtttctgttgtatctgccctgccagccccagtgcagagcagttcaccctatgaccttctgttcctacttgaagattgcctatagaggtaatccccacggaattgttgttctctcactgtagctgggccctcagtgctcccttaactttctttaccatggccttatttgttcttcaactcttccctgggacccccaaatcctctgaggaaatggaggccattgaattagactgttccttatccctacaaactcctctccatctgtttttaaaaatataacagctttactgagttataattcaaatatcatataattcacctatttagagtgcacaattcaatggttttcagtatgttcacagagttgtgcaaccaccaccacagtcaattttagaacatttttatccccctaaaaagaaatcctgtacccattaacagtactccccatttctccctagtgcctcctgtctcccccagctctaggcaaacacaggtctactttctgcctctatagattttcccattctagacatttaattaaaaaaatagattacttaagttgatagccatctgcagatacttctcaggcctgggccctaacatcctattttagaaatcagtgagtgactaccagaaggtaagctccaagagagccagggttttaatctgttttattaactcatgcatctgcagtacctaggacagtgcctggcacatgctgatgacctgctatgggaatccagttacgaacaatatagacatgattcctgccctcttttattgactgactgattgagacaaggttttactctgtcatgcaggccagagtgcagtggcatgatcatggctcattgcagctttgaccttctggtctcaagtgatcctctcacttcagcctcccgagtatgtgggaccacaggcgtgcactaccatgcctggcaatttttaacaattttttgtagagacggggtctctctgtgtttcccaggctggtattgaactcctgggctcaagcgatctgcccgcctcagcctcccaaagtgctggtattacaggtgtgagccactgcacccagcctcttaccctctttgagcttagtgggcaagatagaaattaacagatgcctaattgtagttgtgataaatgctgtgaattagtggatgctgatcattcagctgagaaacttctatctctaggtattttgcccatcttcacatagcaagggatcccaaggatagcactggtggaagacatgattctgatttactctagagaagaccaggggagctcatatgggttatattcagtacaaaaagatgttggagctaatgtgtagactagaatagagtacaaataaaaaaagaagagaccatgggcacatgtgaataacaatcagatcacaaggagatatatatataaaatcatatcagttcccaggcctctcttctgagatagaatactgcccccatccccagtctgtcaatgaagacatgatgcagaggcagactgggacctcaggcttaactaagactttctgactattttggcttctggttgggaattccaatggtggtattgacgtagatgtgtcaagtctaaattagtaaagcctggagctttgtgtgtttcccctatgttatgaacacgtgggcagccaagatgaacagttttatcaagatgattaagaattttgccttatggaaaaaggggaaaagaaaacaaacaaaaaccaacgaacctgaggctccaaatggcaaatgctgcatatggtcattaaccagtaatttgatagaaaattatattgtagagcactagtataaaggatttgctagctcagattgtagcccattcagacacaaatggtaatagaatattttaaaaatttgtgttatggagatgaattaagtattttctaatattactgaaaaattttacaaatgtcattggtttatggaagagtgttagttctttgggtattcatttcctgcttgttatttctgacttacactattttcctccagggtgtcaacttcttaatgacatccatccatcccaactaaatgttttgttttgttctttttttgttgttgttgttgagacggagtctccccctggttgcccaggctggagtgcagtggcgcgatcttggctcactgcaaccttcgcctccaccttccgggttcaagcgattctcctgcctcagcctcccaagtagctgggaggcacccgccacgatgcccagcaatttttttttttttagtagaaacggggtttcgccatgttggccaggctggtctggaactcctgacctcaggtgatctgcccacctcggcctcccaagtgctgggattacaggagtgagccactgcgcctcgcccgttttgttcttttttaatgctctccaagatcatatggtagtagagcttcacttagaatctgtagtgctagggggcaatcactgaaacatctggtctgtttaattttgaagccgtggatttcggttttcacttttgacaaagctattctgtattaataaatttgagcacaactatgacttctagttttataacgtgccatttattgagtgacttacatatatgctactttatttagctctcaacatatctagtaccatgtacattacttttcccgttttataaatgaaggaactgaggctaagaaagtgaatgacttgctcagggtcacatagctagtaagaggtagagccatactggaagtaggcagatctgactctaaagcccacattcttttttttttttttttttgagatggagtcttgttctgttgcccaggctggagtgcagtggtgcgatcttggctcactgcaacttccacctcccgagttcaagcaattctgctgcctcagcctcccaagtagttgggaattacaggtgcccaccaccacatccggctaatttttgtgtttttagtagagatggtgtttcaccatgttggccaggttggtcttgaactcctgacctcaggtgatctgttcacctcagcctcccaaagtgctgggattacagagccaccgcacctggccctaaagcccacattcttaacactctctctgatgcatgattttcaatgctggtagtgcttgcttcacatcatctggaagtggaatcaaacccagtattttcttttagatgaaacggtctcttagatctattaaccaaaagcaaggtgcaaaatgttacatgtgacatgcttaataccacatataatatgtatacatacatatagaaatgcatacacacatatgtaatggtggtacactggagctggctcacaccggcttgggagagccaattgtgtacatcttttcccaatttcatggttggtggttttaccttggcaccttacagtcaaccatggtggtcatatttacatcacggaaatctgcaaacgctgtcagtcaggttttttgttgtattttccagaaagctggttgttaaacattatcagcactctgtaggtttttttgttttttgttttctgcaaggggggagtcatctaagtataatatcttttgaaggaaatgtaagaagctggtaaacgtagattcttccaggaaagagaactgtcaaacccaatatttttatagtgaggaaatttagcaagagtatagaaaagcctcatgaatgatgagaattaaacatcatgtgaattactagtttgttcactactactgtcaagtctttttctcagtgtcttgacagtctggctggcacagtgaaatgatacgttcaagccaggcaatgtgctctgctttctgatcttctcttctaacattataatatgtcatgaaaactaagtgaggaaggacagcaagagtctgtagaaaatgtaggtcattaaaataatccatattagtgactgtactgatgactggtttattgctttgttctgccaccatcttcttgacactctgaatagagatctaatagtccattgagaaactactctggttaccacatttttttctttccataaagcattgcaagggtaaaattctgtttgactgcacactaaacctttagctccccatgaataacaaagaagtgccttcacattaatggaataaagtggtgaaaacatatttattgaataaatttatattagagacagatgggtagacttcgctattactctaaaacaatttctttagttatttctaacgtccacatttttagaatcactgtgctgtagtccacattacaatgagagtatctaggttataatttatttctgagccattattatcaggatatcgtcttattttttatttttatgctggtcatgaaatgtagatcaggatttttgaatctactcttttggaagttttttttttttttcttttaagaggcatggaactaaaacccattttaatcctgaaagttgtatatactaaaagttacattgtatatgctttaagaaactattttgcacatgtgttttttccagatgatttccactgggaggagtatttgaaagagactgggtctataagtgctccttcagagtgcttccgtcaggtatgccaagattctgtagctgttagttaatgtaaactattaacttgttggaggacgtctgtgtgattgttagattctggtagtgtgaggagatagtgggattgtggtagtgcctcttaagagccagatggtctctttgcattcattaagaacttactctatgtcaggtataataagctttatgattgcccatctggcaggaaaggcagacatataaataaataattatgagaagtgtgataactccatactggaagggctcacaggagcgatgctatttgagatggttggaatgggaggaaggatagtccaggcagagagaacatccaaagccaaggcacatgggcatgaaagaatctgagtattaagggatggcttggggtggctggagcacaaagtggatagaggcgataatgtggaaatgaggttaaaggtgtgggggcatttaaactgtgctgaggagttggacttcattataggcagtggtgagctgctggttggctaatttcaaggggaatggtctaatcagattcttactttagaaagccactcggtatattttagaggctgtatttgggttgcctggaagtgggcagatgagtgagaacagcagcgggtagtgtttttatgctgcatgtcaagccaaggagagaattttgaagatcttttccttgactcttacagctctgacctcactcatcatccactgtgactgttatttaaaatgttcctcaggtattctggtgacatagctgtccatgtgtcttctcttatagttgatgcattttaaccaaattttatttatatatatagtctcagattccacctgtgaatgatttcaaagttggtatgaaattggaagcccgtgaccctcgcaatgccacttcagtatgtattgctacggttattggaattactggggccaggttacggttacgactggatggtagtgacaacagaaatgatttttggaggcttgtcgattccccagacatacaacctgttgggacatgtgaaaaggaaggagacttacttcaacctccactaggtaagaagaaagttttaaaaatagcgtattctttctaatgtgatattcaatagaaatggctttaagtggccttttaaaatttattttcttgggcattcttgcaaatagatggtcaggtggttgctgtggagaatgtatgatgagagaggaaatcagcaccatctgttgtggagttttgcttaagtacatatttggcatatgtgtgtagaagttttctccactccagggcaagactcatgctaggtcttcaaacttgaaatgtcaaaaccagctctactagattacatatgcagattcagaactccttctggggaagaactttgtagcgtttgatacaaggcacatgctctctcaatattgtccactgagccattcagcaattttggtatggggataagcctaggggaagggtatgattccacattcaggttccagtttcaaactcaagaatttcatttcacctacagtgggaagaaatcagagcgagagggacaggaattagtacctttaggtctttgaaaaggagaaaatggagattttagcaaagattttaaggtacaaaatatgtactttaattttggccacatttttgaaaggtaaaaagggtgtaactaatttggggcaacatttttctttttaaaatgtaagcataccatgatactctgtaggaaagaaatgatttagtttatttagttgctgttctatactttgagtgaatggtgggcatttacttttatttggttctttacagtgctgaaaatgaaaattccttgttgcaaagcacaataaaagaatggatttttttgttttcctattagtgaaaaattcctttttcactaatttaagtgaaaatttttcacaaatttaagatattaacaatagccactctttagtaatatatctttatgctgtccttgttctatttgttcgttataactaatttggtttaaaaaatatttttttttgagatggttttcactcttgttgcccaggctggagtgcagtggtgtgatctcggctcactgcaacctccgcctcctggtttcaagcgattctcctgcctcagcctcccgagcagttgggattacaggtgcccgccaccacgcctggctaatttttgtatttttagtagagacggggtctcaccatgttggccaggctggtctcaaactcctgacctcaggtgatcttcccacctcggcctcccaaagtgctgggattacaggcgtgagccactgtgcccggctaaaatatttttaaaaactagttggagatatgttattccaagaagatggtttggggcatgtttgttttttgccttttgccttctttcactcacgtcttttgtcgtttatttgttgtttataatatttctcaaattacacagaattctatgtgaaagataagtgcaatcctaggcttagtgcttccctatttggattttatttctcttgttgcaatatggtatgtttttgcagtttgtttaaaggagatgctgctgttgtaattgtcagcatttcaaatacataactagatttatggtcattctttttaataaaattcttagactttgttttatttaaaaatatgaaatgtatagaaatatgtgctgattagtatctgttttggcagtatatttaaaaatgcaccattggtgccagtttgctttttaggtacttttgaatagtttaacttccattttaatacaacttatttagttttccttttaaaaagatttatttgtttaaactttaaaggttattattaaaagattttataaagttttaacacacaaactgaaaggtgtacaggtcataagtatatagcttataaatgaacacatctgtaaagccatcatccaaatcagaaaatagaacattatcagccccccagaagacctgctcctgctgataaccagccataatctctcctttcctaaaggtactaccatctatacttcctaaccttatagattagttttatctctttttaaagtttttatatgtaccttaatccaattttggtcttttaatctatgtttgactttaagcaattacagaattaagtaaaatgttacatttaggaaaatctgggcacatgatggaataggataatatgggagttgagagagaggcttaaggaccagagaatgattcttatgcaatactctccacagaatggagaataataatgttgatttattataagggagtatgtaacaaatctccccccacccctgtttttttttttttttttttttcaacaattgtgtctctggtcagattaaggggattttggtacaggattattagaggatgactttccatcttaccttttttgtatgttttgttttattgatggaaaataggacaaaacctgcacccattgccaatgattcatgtgcctccctgtcttaatgtatgcatgcatcaggggcgcataccaagttctttctaattctggcattgaggcaagcaggtgttgcatgaaacagattgcccccagaaagcagtaaaactagcagaaccctgctccctgctgcatatgccagatgctgtgaagccattagttggtgagatctctagaaaagacacctgttgagtctattttgatagcatctgatacaaattctaaaagaagatcatttttagtatgtattaagattgctaaagtgagagctgtcttttttctaacacattttatggagaatttcaaacatacagaaaaggtgaaaaaattttacagtgagtacccccatgtccagtttctagtttctaccattatcattttattatatttactttatcacatatctgtctatctatctgcccttctatttattcatcaatccttcttattttttagtacatttcagagtgagttgttggtatcagtgcacgtcccctaaatattttagcatatatatcattaacgagtcaatatctataggtttttttcttttgaggtaaaattgcatgcaatgaaatgtactgttgtgtgtgtatatgtgctgagtttgacagaaaactgtctttctgaagtgaaagaagcctggggccctgaggaaaagggggctagaagtcttttacagcctttgcccttgcttgtgtgattgttggtggtggaatggaagctctcctaggctccagcttagatcaccccttgtattatatacatgtttgtttgtgaattctagctagtgacttctcttaaaaggagagtttctatccccactgtagcattgttgccagacagtacagtggggacactagcaatgagaggagggtacatctgctcctcttgcccatgttcaaagttcttagataagaaagtcattctctcgagaagaatggtgaatgaaacctattttttataccaacttgttaatagtatcacaaggaggctttttcatgatacctaatttattttataaaacagggtaccagatgaatacatcctcctggccgatgttcctcttaaagacactaaatgggtctgaaatggcatctgccacattatttaagaaggtaagaaagatgttataaaaagctgccatgtttttattgttttagtgggaatgcttaaatgcttaatcttctgtgacatggaaaagcaaacatacttttaaaattactggattggcaagtgtattagtttgctagggttgccataacaaagtaccacagactgggtggcttaaacaacagaaatttattttctcagttctgtaggctgtaagtccaagatcaaagtgccctcagatatgtgcaatgctccaccattagcatatagacatgtttgtatctccacaccttcactaacattgaatattattcatcttttaaaatgttgggaatcttttttgtgggggagtggtgaagatgaggatggtatcccattggtttctggtgagatctctcttcttggcttccagatggttgctttcttgctgtgtcttcacatggccttttctctatccatgcacatccctagtgtgtcttcctcttcttatagggacaccagtcctattggattagaggccgacccttatgacctcacttaacctttattacttccttaaaggccctatttccaaatacatatatgttgggggttggtgcttcagcatatgaattttgagatgatacaattaaattcgtaacaatagcttaaataatagaaatatattttctcacagttgcggaggctagaagtctgagatcaaggtgtcagcaggtttttttttttttgttttttttttttgagacagagtctcacctgtcacccaggctggagtacagtggcacgattttggctcactgcaacctctgcctcccaggttcaagcaattctgccttagcctcccaagtagctgggactacaggcgtgcaccatcatgcccagatactttttttgtatttttagtgaggtggggtttcaccatattggccaggctggtcttgaactcctttttctttttttttgagactgagttttgctctgtcacccaggctggagcgcagtggtgtgatctcggcttcccgggttaaagcaattctcatgcctcagcctcctgagtagctgggattacaggcgcgtgccactacaccaggctaatttttgtgtttttagtagagacggggtctcgccatgttgtcctggctggtcttgaactcctgggctcaggtaatctgccagccttggcctcccagagtgctgggattgcaggcatgaaccactgcccctggccaggtttggtttcttttgaggcctctccttggcttatagatggctgccttttccctgtgttttcacgtggtctgtttattcgtgtccaatttgttcctcttataaggatgtcagtcatattggattagggcctaccctaataaccttattttaacttaattacctctttgaagaccctgtgtccaaataccatcacattctgaggtactgggggttagtgcttcaacatacaaattttgggggtgacacaattcagcccagaacagcaagtcataaaaaagtctcaattacaataacccactggtccaatttcattagcagcctctttcttgactgtagatataaaaagagtgctctactggaagcaaatattcattgctattttttatttgcattcagaagtgaagcttcccctcactttactgtgttagtccctttgatattggagaaaaagatgatgggccaaaaaatcactcgaaagttagttggagagatttggtttcagaagtaatgttaaaagcagtcatcagaaagaatttgttatgaggaaatacttggtatataaaaaaagaggaaaaatttccaaagtagtttatgttcttgagaaaatgttgaagagtatgttaagaaacaataaaagccacgttttagttaaattatgagtcagaatatttctttctcaccttttctcctgattgtttttcaatcacttaacttttattacaactatacttggaatggtaagaattgattgttgttttaaaaagcttttgaagaagattgaaggcataaggatgtgaaacatcaattactatgcctccattgcaaagaaaaattctgtgggtacgcctctgagtaagatgaatgcagaaagtggacttgccctacctgcaagggacacaggcagcacaggccctttggccagtggtaagccatgtgtgagaatagccaattaaaaaatatttagcagaagtctttatttattgaacacctattagcttgggctgtggctttagaaaagccattggatctgttttactagtcagattgcttaatcagcatgccacacttgtcatacacattatattttcaatttttttaattataaaagtaattcatgtggtggggggcaggggatgggaatcaagctatactcttagctagagtgaaaaatgcatctccctttgtcccaaccattccttcattcctctcttccctccaaattgaagttttatttgttctcccagacctttttcttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcctgctaccacgcccggctaattttttgtatttttttagtagagacggggtgtcaccgtgttagccaggatggtctcgatctcctgacctcgtgatccgcccgcctcggcctcccaaagtgctgggattacaggcgtgagccaccgcgcccggcctttctttacatttacaaacaaatatgggcttttattttcttaaacatcagttggaatatattgtacatattattctgtggtttactttttctcctaacagttttggaaatcattctatttcatttcatatatattttagcttgtattgtactcttgtgtagtatggatcatcagaattcatttaaccctagaattgacttaactgtaaggatggatgattgggtcatctccacattcttgtttagatcagctctatagtgagcattcttttaaagagctttgtgtataaacgtgaacggttgcattcttggaactagaattgcttgttcaaagggatgtatgttttggctgggcatggtggctcacactttgggaggccaaggcaggaggatcatttgagcccaggagttaaaaaccagcctgggcaacacagggagaccctgcctgaaaaaaaattttaaaaattataaagaaaaaacaaaggggtgtatgttttaaatgttgatatatactgtgaaattgcatccccaaagggtattctaaggcagcagtccccaacctttttgtcaccaggggtcagtttcgtggaagacaattttcccatggatggaggggtgggtggtttcgggatgattcaaacgcattgcgtttatcattagattctcctaaggagtgtgcaatgtagattcctcgcatgtgcagttcacaatagggtttgcactcgtatgagaatctaatgcctctcttgataggagacagagctgaggtggtaatgcgagtgatggggagcagctgtaaatacagatggagatttgcttgcttgcctgctgctcacctcctgctgtgccacccagttcctaacaggccacaggccagtaccagtctggggggttggggacccctgttctaagctatgctccaccattagcccataaacatgtttgtatctccacaccttcactaacattgaatattatccattttaaattttcatgactctttttttggagggagtggtgaagatgaggatggtatcccattgttttaatttgcattgcactgattactagtgaaattgtgcttttaagatttgtttaatggccttttgtttttctgtgaattgtctgattatagcctttgcctatttttctgttttgtttttgagacagagtctcactctgtctcccaggctgcagtgcagtggcgtgacctcagctcactgcaacctccgcctcccgggttcaactgattcctgtgcctcagcctcccgagtagctgggattacaggcatgtgccaccacacccagttaatgtttgtgtttttagtagagacagggtttcaccatgttggccaggctggtctcgaattcctgacctcaggtgatctgcctgccttggcctcccaaagtgctgggattacaggcgtgaatcactgtgcttggccctttgactgtttttctattggatttcttttcttcttagaatcatcatcttaaatcctcacttttccttgattttggcctctggaggtccactcacttaggttcctaattatttatttgtcctgtttctttctaaccttaccaccactgctccttgggcagactgtcaacctaaaataacagcagagaaataggctctccaaaaaaaaaaaaatagtctatttgggaacgaatgacaagggattacaatgcaggatgtttgtgctgtgatggatcattggcatatctggtgaaggtaaggcaaagggaagcttttaaaggcaaaacaaggaaggttacataagttgttttgaaacacttatccttggccacaaggatcaataacaagagtggtatctggggttgaacggttactggatagatgtccttgcaggagtattctttgtgtgaggttgtggttttcagagagtccttgtaatagtttttatcataggcgtgtgtacatgagagcccctcctctatggtccattttgttagggtttggcataagtgactccattttgattctgacaacttttataaggctctcctcttgcctgaactgttatgctagccttttaactgcctctaatcttcaccctttcacacagccgctagaaatgtgtatcttatacaaaaaccttaccatgttattcccctgtttaaaactcttttgaaattcctggttatactcaggaagaagtataagtttttcaatatggcctgttaggtcctgtgtgatcaaatttagggatgccactccctgctttggatgttatgttcttaaattgcttgtgaaagcttgtagatacctgtttatttttagagctctgttttgactcatgttggtttttcctggttagctcctactttttaaagattcaagtcagatgttaaatcctccaagataatatccctaattccccttctccattcttctacttttttttttttttttttttttttttggtgagacagagtctccctctgttgcctaggctggagtgcagtggtacaatttcacttcactgccgcctgcaacctctgccccctgggcttaagtgattctcctgcctcagcctcccaagtagctgggactacaggcacctgccaccacgcccggctaattttttttgtagttttagtagagacggggtttcgccatgttggccagtctggtctcgaacccccaacctcaaatgatccacccaccttggcctcccaaagtgctgggattacaggtgtgagccactgtgtccggcccattcctatacttctatagcattgtatatatcccaatctttgtatgtgttagattatattattatttttactgtctctcttcctggactgtgagttccttttgagcagttagcatgtttttgtattgtcagtgcctatattagtttctggacacatacttgtttgttaaaagaatgaagaaaggataaaagaatacaggaagataaatatttatggaaggaacagatgggcttagttttgaacgtgttgaggtgtctctgggaaatttgagtagtgatgactatcaggctgttgaaagtaaatggtttagaacttaggaacaaagtttggcttgggcacatggatttggaaatttttagcagaaatagtagtgatagaagctttgagcttaaatgagctagtccagagaatatatagaaggaagagagaggagtgtcaaggtgagagccttgagaaatacctacctaccttatagggtgggtaaagggataggagcagctctagaaatggaggaggaaaactagaataagccagtgtcattgaatccagtggggcagagttgcaaggattagggagtggttaacagtctcaagtacagcttagaattacacagtgcctggcccatatcatgtacttaaggaaggtcatttatgaggaaagctgatttttgactatttggtagatagaaaatcatcagttacattagcaagagctaaagtccaggtgaaaagtgtcctcagctaaatttataattttgggcagactatatggagatcattcctgatggcttcaatttactatttctataaatagacctcaatgatgggaagatcacttgagtctgggaggttgaggctgccatgagccatgatctcgctactgcatgctaaccttttagcctaggtgacagagtgagaccctgatttaaaacaaaacaaaacaacaacaacaaaaaaacaaaacctcaaattcctatttctgcaaagtaggaaactggcaaaggctggaagaaaattcatacatactggttggggataaagtcagttaacaaaataacaaacatatagtgaggctacatcatttatctcaaggagaatggttaaggtttggaacagctgccatacgggatgggagagggaatggtctagggacacatgacagtattttggagggcttagctaaggatgaagggtaaaaatgtgtgtcactacatgtaataagcatgtgggagggactttgctgcagcagtgctcagcagctgtattagtctgttttcatgctgctgataaagacatgcctaagactggggagaaaaaagtttaattggacttacagttccacatggttggggaggcctcaggatcatggtgggaggtgaaaggcacttcttacatggtggcggcaagagaaaatgaggaagacgcaaaagtggaaacccctgataaactcatcagatcttgtgagacgtattcactaccacgagaatagcatgggaaagaccggcttccatgattcaattacctcccccgggtccctcccacaacaagtgggaattctgggagatacaattcaagttgagatttggttggggacacagccaaaccatagcagcagctaagtataaataggtgaagtggatggtgatattgaactaaggtttggaataacagggcaaagacaagggaataagttggttttggatgctgagaagagagtagtgaaatgatgctttgtaacctagatatgagtgctgcttcacatcctacaatgcacagaatacacatacacacacacacgcgcacacacacacacacacacacacacacacgcacacccattctggctccaaacgtcagtagtgccaaggctgagaaaccctaacctgtattaatcccctggtgagctcatctaattatctggctttaaatacagtttatatgcaaatgattttcaaatttgtatttctaccccagacctcttactcccaactcagatttgtatatccagctacctactctacatctccacttggatgtctgatggacatctcaaacagttccacctgttaacctccctatctcagggaggggaaactatctttctagttgctcaggcctcaaaccttggtaattgtttctttcacaccctacatctggtccataaggaaatcctattgactgtaccttcaaaatacagtcagctttccatatcctcgggttctgcatctatgggttcaaccaactgcagattgaaaatattaaaaaaaaacaaacccaaaatacagtaaaaaatagtacaagtgaaaaaaatatagtataacagctatttacataccatttatattctattaggtatcataagtaatctagagattacttaaattacttataatctagagattatttaaaatatatggggggatgtatataggctatatgcaaatactgtgccattttatatcagggacttgagtgtccttggattttggtatcttcagtggatcctggaaccagtcctctgtggattctgagggacaaatgtatatccaaaatccaaccacttcttgccgtctccattgttaacactctggtacaagctgtctttttcaatctcagttggattactgcagtagcttctcactggtctctgcatttataactttacaggctatcatcagcacagcaaccagagtattccttttaaaatgtaaatcacagccgggcatggtgcctcacgcctgtaatcccagcacattgggaggctgagatgggtggatcacttgaggtcaggagttcaagaccagcctggccaacagggtgaaaccctgtctctactacaaattgaaaaattagctgggcattgtggttgcgcacctgtaatcccagctactcgggtggctgaaacaggagaattgcttgaacccgggaagcagggattgcagtgagctgagattgcgacactacactccagtctgggcaacaagagtgagactccgtctcaaaaacaaaaacaaaacaaacaaaaaacccacataagtcaaattatatcactcctctgttcaaactcttccaggggcttcctgttttactcagagtaaaagccagaatccttacagtgatctataaaactatatatgatatgacccctcattatctgtctgacctcatttcctactgctctcctacttacattttacccacactcaacttccttggtgttctttgaacatttcagacacagctcctgctttagggccttggttctgtccatttccctccttcagatttctgctcacatgtcaccttctatatgagacttgttttaatttctctatttaaagttgtacaacccctcctacatttctctctggatttttcctattgtgctgttctctctctctctctctctgcatagcatttatcatttctaatgtatgtgttttactttttaaattatgtttattgtctctcctcactagcatgtaagtgctgtgagggagggattttgtcttttttgcttgttaatatatcccaagaaccttcagtagtgtccggaatatagtagatactaagtaaatatttgtaaatgaataaatgaaggttaaaggactaaaattattggtgaggtcaaataagtagttgattaaaaataaggagatagaagttcatgtattagtttgtggtcagaggcaggtactgggaatatagcagtaaacaaagcataaaatatgctcttatggagcttactttctacttggggaaatgtttaatagatatgctaaataaagaaagtgtatcttatgttttatactctcacatgtttagaagagaggtcgacattttagacaggttggccaggagggtctgagaaggtaccttttgagtaaagatctgaaggaaggcagacagtgaaccatgaggctacaagagtaggattattccccaggcagaggagtaatgcagagaatgctgagactggtttcggattttgtgggacatgggaagaaatagcctttaaggagaaccatattgtaggtaatcaagaagggaggttaaaagctggatgtggtggcacgttcctgtagtctcagctacttggaaggctgaggcaggaggactgcttgagcccaggagatttgagtccagcctgggcaacatagtgaggagaccctgtcttttataaaagtaaaagtaaaataaaataaaatagaaatgaaaaaaaataaataaaataaatataaaggctgggcgcagtggctcacacctgtaatcccagcactttgggaggccgaggtgggtggatcacctgaggtcaggagttcgagaccggcctggccaacatggcaaaaccctatctctactaaaaatacaaaaattagccacgtgtggtggcacgcgcctgtaatcccagctactcgggaggctgaggcaggagaattgcttgaacccaggaggtggaggttgcagtgagccgaggtcgtgccactgcactccagcctgggcaacagagagagaccgtctcaaaaaaaaaaaaaaaaaaaaaaaaagggaggtggttaaaagagcattctttgctagccatcttctagaatagaaccatttttgtctcaccgtaaaagagaattccttgtttattttagctattgcttttgcaaattatatttttgtgttcaggaagttattaaagaaccgatgatgatgacaaaccaaattctttaaaagcatttcacttaacataatgacctccagttctatccatgttgctgcattgacaggatttcatttttatagttaaataatattccactgtgtatatatatcacattttctttattcacctgttgatggacacttgattttttttgttttctctccaacttttattttaggtacatggggtacgtgtgcaggtttgtaatacggatagattatgtgctggggggctttggggcacagattattttatcacccaggtaataagcatagtagccgataggtagttttttgatcctcaccctcctcctaccttccaccctcaactcaagtaggccctggtgtttgttgttcacctctttgtgtccatgtgtactcactgtttagctcccacttgtaagtgagaacatgcagcatttggtttatctgttcctttagggtaatggcctccagctctccatctgtgttacagaggacatgatctcgtccttttttatggctgcatagtattccatggtatatatgtaccaaattttctttatgcagcccaccattgatggacatcaaggttgattccacatctttgccattataaatagtgctgcaatgaacatacgcgaacatgtgtctatggtagaacaattcattttcctttgggtatatacccagtaatgggattgctgggtcgaatggtaattctgttataagttctttgagaaatctccaaactgccttcctcagtggctgaactaatttacattccaaccagtagtgtataagtattttcttttctctgcaacctcaccaggatctgctgttttttgactttttaataatggccattctgactggtgtgagatggtatctcattgtgggttttttttttttttttttgagacagagtctcattctgtctccaaggctgaagtgcagtggcccaatctcggctcactgcatcctctgtctcccgggttcaagagattctcatgcctcagcctctcaagtagctgggactagccaccatgcctggcaaattttttgtattattcgtagagacagggttttgccatgttgaccaggctggtcttgaactcctgacctcaggatatccacccacctcagcctcccaaagtgctgggattacaggcatgagccactgcaccaggccatctcattgtggttttgatttgcatttctctaatgattagtgatactgagcatttttttcatacgcttgttagccacttgtatgtcttcttttgagaagtatctgttcatggatggacacttttgattccatatctggctattgtgaatagtgttgcagtaaacatgggagtgcagatatctcttcaatatactgatttcctttcttttggttatgtacccccagaagtgggattgctgggtcatttggtagttttatttttttctctatgctttctcaccaacatttgttatttttttggtctttttgataatagtcattctaaccggggtgagatggcatctcattgtggttttgatttgcatctcttggccatttctgtgtcttcttttgagaaatgtctattcaggtcttttgcccattttaaaatcaggttatttgttttttgctattgagttgtttgagttccctatatattctagttattaatctcttgtgatggatagtttgccagtattttctttctccctttctgtaggttgtccttccctccctccctccctccctccctgtcctttcctccctccctgtccttccctccctcccttccttcctccctcccttcctcccttccttccttcctgtttttttttgtttttttttttttgagatagcatctcactccgttgcccaggctggagtgcagtggcaccatcttggctcactccaacctccacctcccaggctcaagcagatcctcctgcctcagccccctgagtagctgggactacaggcatgcaccaccacacccagctaattttttttttttcttttgagacgagtcttgatctgtcacccaggctggagtgcaatggcatgatcttggctcaccgcaacctccgcctcctggattcaagcgattctcctgcctcagcctactgagtagctgggattacaggcatgcaccaccacacctggctaatttttgtatttttagtagagacggggttccaccatgttggttaggctggtctcaacctcctgacctcatgatccacccacctcagcctcccaaagttctgggattacaggtgtgagccaatttttatacttttttagagatagggttttgctaagttgcccaggtggtctctaactcctgggctcaaatgatctgcccacctcggcattccaaagtgctgggattacaggcatgagccaccatgcctggcctaggttacatatttgaatcttaaaattagttctattgcattgcttattccagttttttaattgttttgttgcagaaaatatacattgccatttgaacttagtttgctttgctacagaaagtctcagtctgttataagacagtgtaaggtcctgggatccttatgtgtgccttgaatgttttctgcattctgtgagcatctagcacaaacttgtcaactgccgtgtttattctttgttaaatgcagcttacctccccactattttcttctcatacatagtaacaggcagttaacctttagccctttcatgtaacactgcttcttacttaccagctatttatcaaatactttgatctttaatcatctaccttttgacttgccagctttcagggtggattttttttttttgaggcagagtctcactctgttgcccaggctggagtgcagtggcaagaacacggctcgccgcggcctggatgacttccggggctcaagtgattctcctgccccagcccactaagtagctgggactacaggtgtgctgccaccatgcccagctaatttttgtattttttgcagagacgaggtttcgtcttgttgcccaggctgttgtcaaactcctgagctcaagcaatccacctgccttggcctcccaaagtgctgaattagggattacaggtttgagcccagggtggtttttaagaatcaaattaagatatgtaattcagcctggcatggtagctcacacctgtaatcccagcagtttgagaggctgaggtgggaggattactttaggccaggagttcgagaccagcccggccaacatagcgaggccctcatctctataaaaataaaaattaaaaaaagaatatgtaattaaaaggactttggaagctaataattaaggagcttccagatcgtaagggtgtaaagagtaacaatagaaaaatacagggtgatgagatgggttttaaggggggcatttgaaaaagaaaccaacctaccagatatattttttaaattgatgagagaattagttgagagcttatttactgttttggggtgattccttggttctctcatttaaaaaattgcttgcttttggttattgtgctggaaataataatatgaatagctgtttttaataatctcttagtctcatagaggaatgaacacatttctatagtgatactacaattgaagatgagagtggctcagttggaactgggcctaggagtgggcaggggttggtcagggaagcattcaaggaagctaggagaactgggctttaaactgggtgaattggagttgtccaggcagatgctggggtagggtgctccaaggaggtgactccgagacagactgcctaggtttaaaatccagctctgattgggaggttgtggtttttaattgaattatgggtaagtgaaagggatgaatctagggtagtggttctcaacctcaagtgcaccttagaatttccctgataattaaaatattgctgcttcccaggacccaccatagatcaattattagctctggtggtgtggtcacaggtgattgtaatgttcattagggcagaaaatcaccagtccaggactacttttttttaaattcttttcttttctcttttaatttgaacaagtgtcagtagaataggattactatttccagtcttttggcttaggtgactgggttgctgtgatggtgccatttagtaggatgaaaagcagattgaaagaaaagatgttgcttttaacataacacttgggctttttagcaatcctgttaacatttacgtgctttaacctttttgtgactaatacttttaaaatgttgatttctggattgggtattataaatgaccccatactatatgactttcatgttcttgtgtctgtattttatacttacagtttcttttttttttttaaattttaagttattcattttctttagaattcttatactttgagtttcttttaggatattatctgatgtcgtttcttttctttggacttaccactttttgacacaccaatttacatatttgttaggtttgtttgactgcctgttgtaaaatttcttgttgattgcttttccctgtccgcaaccactactatcaccagcattagaatgtaagctccaccagagcagggatgtttgatatatttgttcatcaatgaatcttaaattcctggtacatagtagataatacatatttcttgaatgaatgaacccggctggttttgtttctttccaggttcttgactctgctccagagaaaatatgagatgttggagagcagagtttcagatctgtgagaactgttgtcttcctgtattaattgataattaaacatggagcttaatttttggttgctaagggttgtgagagaatacgcaacttttcacttcgagcacatgagtcttaatacatcttaacaatgaaatcttttttttttttaatgttttgataggaaccaccaaagcccccactaaataattttaaagtggggatgaaactggaagctattgacaaaaagaacccgtatctcatctgtcctgcgaccattggagatgttaaaggggatgaagttcatatcacatttgatggctggagtggagcttttgattactggtgcaagtatgattctcgagatattttcccagctgggtggtgtcgcctgacaggagatgtattacaacccccaggaactagtggtaagataataattaactactttttcttctactttattgaagttagatgtaactgtcattggtggcattgtgattagcgttggtggtaccaggtggtacatgccccaactggtggcagacagaacaaagcgctgtccaggctagagaactggaggtaaaggaaagctatgattagaattcttgaggtcactgcagcatcatagtctgagttccagtccacactggagattatggacaaagctaaaagtcatatttggaccattgaggtcttgttgctataagcaaggggggtggtatgtactcagctccttttatagttgatattcaattaaaaattatacatggtattccattgttcatatctcaaagatattttttaaaagactgggcttaacaactgttataaacatgtcttacatgatttttgtcctgtttttaagttaaattgacactttgatagccttaagttaaatctacagtgaaaatttttgactctgtggaagccatcataaattagtatgctattttagtcatggtaatgtttattagttgtaacggtgtttcctaagctgagtactatgatcttctagatattttctttcagagaaaagctgtcaacatgttgatgttccttggtgactctttcaagggcttagatatgcctaacctggtcttctatgatggagtaactgctgaggcttaagtggggtctaagcatagaacccaatcattggcctaagttaatataaacttagtgggattcaattagccgggcgcggtggcgtgtgcctggaatcctagctactcaggaggctgaggcaggagaatagcttgaacctagagggtggaggttgcagtgagctgagatcgcgccactgcactcctgcctgggcaacgagaacaaaactccgtctcaaaaaaataaataaatgaaaaatcaacttagtgggattgaatataaacatacttaaaaaactaacgctactaagtatatttatttttatgagaaaaaaagatagatgtagaaaataagtacgcaaagtgtgcagaggagtataatgtctaggtaagagcttatagccatattattcttgcaatggctgttagaatcatctgtaattcgggactttaacacattccattatactacagtactgtataccacagtgtcctttttattaggtacatctttaaccagtttcctgcttccataagtctaggaagtagatattaatggttgattttgtaaaatttagtatgatacagatctgtgtgtatatgatattaagataaataaaacatagtctctaccctcaagaagtttaccttctaatggaagagggatgcatggaggcatagatttgtaaaaagaagatatagtattagcaatgcaaaaatagagatgtatgctagatgtggaggtggcccaaagtcttccagtcttggctggagggaaaggtggttgcataaaggaaagcatcacaaaaggtgcatgatgtgagtattagatgagaagcaggagtttgccaggcagaatggagataaaagtaggatggatacataacaaaagtgcaaaattccagtttatcctaaaaactgacgagttcactttggaacacagtgggtttggaacgtgtggctgagaatgctgttgtcctccagtatttcttctctctttttttcttagtattacaattggctgcctaacatacagactcctagcagtatggtatggccacgagactaagtcctgattgatggaataaaagtacacatagtgtgtactttctccagaaagtatattatagagagatgagcatgtcctttccttttccttctttctgcttttatcctgctgttacgaatgtggttttgactggagctccatcttggagcatgagatggggaccatatgctaggcactgtggagtgggtggaaagcagccaggagccagagtccctgagaacttggtggagcagagctttcatactagcccatattatctgttttcagacaattgtgagaaataaacttctatgttatataagtcactgttcttttaggtttttctattactgctagctgaactcaatcctaactgattcagggtaactttgggacatccaggtgcacatgttcattggatagctgcacatgcagatctggagcctaaaaaagataggtcttgttgacaaagcaggtttgagagtcatcatgttccctcagataaatattctttgtgccaggtgggattataggtgcttgggatgggagggtgagcagtttacttattttgttgatagcagcaagtggtggaagttttgagtgtgttttaattgtgtgtgtataacaagtagaggtagaaaaggaccaggacagaaccttgtgggtcgacatttaaagcagtaattatcactcttgaattgcctgggggagcttgttaaaagggagtgctcgggaactcacatccaggggtttgaatccgtgggttcgaagtggggctcagttgtttccagtgcacatggtttgaagcctgaactttgagaagcacaaaaataaggaataggtagtagaagtcaatctaggacactggaaaaaagtatacgtaaatgtaggagatcactaggttggcttccatggcaacaggagagaaaagattttaaggagaaagtactcaacattatcaaaggcagtgtaaaagtcaagcaagaggagaactcgttagcggtcttagtaaaactgtggttactcggcttctttaaaaagctagatttagagagtcaaggagtaaataggaaatgtacagtgttaaaaagaaaaaaaaaagaaaaagaaaaagtggtttcccaatactttgtgagatctgcttcctctgtctttaccccagttgacattcactttgagtgaactttagaaatcttacctcactttatgtccctttaccctctattatatataattgtcttcaatattgagaaccacattagtattataatttttgcttccaccatcaaacataacttagaaaactcaagagaaggaaagtctgttgtatttatttacatttttaccctttaaattgttcttaattcctgattttcaagatttccttattttatcattttcttcctgtttagagaacttcttttaaccattcttttagggttgggtggcaacaaattctctgttttttggagacagagtttcgccgtgacacccaggctggagtgcagtggtgcaatcatggctcactgcagcttcaactctccaggtgcaagcaattgatcctcttgcctcagcctcgccagtagctgggactacaggcacgtgttaccatcccaggctaattttttaaatttttggtagagacggggtctaactgtattgtccgggctggtcttgaactattggactcaagtgattctccctcttcagcctctcaaagtgttgggattataggcatgagccaccacacctagccctcctcttcattcttgaaggatagttgctggacatggaattctaggttgataattcctttcatttttttcttttttgatttttttttttcctgagacggagtctcgctctgtcacccagcctggagagcagtggtgtgatcttggctcagtgcaacctctgcctcctgggttcaagtcattctcctgcctcagcctcctgagtagctaggactacaggtgcccaccatcacgctcagttaatttttgtaattttagtaaagacggggtttcaccatattggtcaggctggtctcgaactcctgaccttaggtgaaccacctgcctcggcctcccaacgtgctaggattacaggtgtgagccaccttgcctggccaataattcttttcttttcacacttgaaaagtattctgcaacttccatctggcttctgtggtttctgatgagaaatctactgttattcagattttttttcccttacagacttcatataattatggatttgttttttcttgtatttctttcagtgtttgctttctgctttatctattttgtggctgtattatcaagtgtgtaccagttttgaattattataatttcctggtgaactgaaccttccacggtaacctgatttatttatggtttttctccttttgctggggaaaccaacctaatgattttttttttctttttttttttttgaaacggagtcttgctccattgcccaggctggagtgcagtggtgtgaacttggatcactacaacctctgtctcctgggttcaattgattttcctgcctcagccttctgagtagctgggattataggcgtctgccacaacacccggctaatttttgtatttttattagagacagggtttcgccatgttggccaggctggtcttgaactcctgacctcaggtgatccacctgccttggcctcccaaagtgctgggattacaggtgtgagctaccatgcctggccgatctttttttttttaaccttaacgtctgctttatctgatgaccagattttgtgtggatgatgtttttgttatctttttctgactaaggctcaaactttttttttttttgagacagggtctcactttgtcacccaggctggagtgcagtggtgtgatcttggctcagtaaagccttgacttcctgggctcaagtgatcctcctgtctcagctccccaagtagctgggactacaggtgcgcaccatcacacctggctaatttttgtatttttagtagagaccgggtttcaccatgttacccaggctggtctcgacctcctagtctcaagtgatctgcctgcctcggtctcccaaagtgctgggattacaagcgtgagccaccacgcctggccaagaagttgccatactgtttttcataatggctatactaatttacattcccaccaacagtgtataagagttcccttttctggccaggcatagtggcttaccctataatctctacactttgggaggccgaggtgggaggattgcttgaagccaggagtttgagaccagcctgggcaacacagtgagactctgtctctacaaaaaaataaaaaggtaaaatgggcatggtgatacgtgcctatagtcctagctgctggggaggctgaggtggaaggattgcttgagccctggggctaagagatcccagtgagctatattcatgtcactgcactacagcctgggcaacaaagcgagaccttgtctctatttaaaaaaaaaaaaaaaagagttcccttttctctgcatcctagccagcatctttttttttgtctttttaatagtagccattctaactggagtaagatgataactcattgtggttttgatttccatttctctgatgattagtgatgttgagcattttttcatatacttgttggccatttgtatgtattgttttgagaagtgtctattcagatcctttgtccactttttttttttttgagacggagtctcactcagttgcccaggctggagtgcagtggcgcgatctcagctcactgcaacctctgcctcccaggttcaagcagttctcctgcctcagcctctcgagtagttggtactacaggcgtgtgccactatgcctggctaatttttttttttttatttttagtagagatgggatttcaccgtattagccagtatggtctcgatctcctgacctcgtgatccgcccaccttggcctcccaaagtgctgggaatacaggcgtgagccaccttgcccagcccctttgtccactttttaattaagggattattagttttttcttgctgttgagttccttgtatattctggttattagtcccttgtgggataaatagtttacaaatattttctcctattcaagggttgtctccactctgttgattgtttcctttgcagtgcataagctttttagttttatgtagtcccacttgtctgtttttgtttttgtggcctgtgcttttgaggtcttagccataaaatctttgcttagaccaatgtgctgaactgtttctcctatgtttccttctagtagtttcatagttttatagtttcgggccttatgtttaagtctttaatgcattttgagttgttttttgtatatggtgagagagaggggtctaggggactagtttctttttttttttcttttttgtgagacacagtctcactctgtcacctaggctggagtgcagtgcaatcttggtgcactgcaacctctgcctcctgggttcaagcagttcttctacctcagcctcccgagcagctgggttacccatcagttagagacggggtttccccatgttggccagtctggtctcgaactcctgacctcaggtgatctgcctgccttggcctcccaaagtgctggggttacaggcatgagccaccacgcctggcctagtttcattcttttacatatggatatccagttttcctagcactgtttattgaaaacggtgtccgtgtcccaatgtacgttcttggcgcctttgtcaaaaatcagttagctgtaaatagatgggcttatttctgggttttctgttttataggtcaatgtatttgtttttatattaataccatgctgttttggttactatagccttgcaatgtattttgaagtcaggtggtgtgatactgctctcttttttttgctcaggattactttggctatatgggctctttttggtttcatataaaatttaggattgttttttctatttctgtgaagagtgacattggtattttgataaagattgcattgaatctgtagcttgttttgggtagtgtgttcattttaacaatattaattcttctgatccataagcatgggatgtctttccatttgttcatgtcctcattagtttttttcatcagcgttttgtagtttttcttgtagagatctttcacctccttggtaaaatttcttcctaagtgttttctttcttcttcttctctcttttttttgagactggttcttgctctgtcacccagggtggagtgcagtggcatgatcacggctcaatacagcttccacctcctgggctcaaacaatcctcccacctcagccttctgagtagctgggactacaggcatgtgtcaccatgcccagctaattaaaaaaatgttttttgttttgttttgttttttgtgtttttttttgtagagacagggtctcactgtgttgcccaggctcctggactcaagtgatcctcctgcctcagcctcccaaagtgttgggattacaggtgtgagccaccacacccagtgttttatttcttatgtggttattataagtggaattttcttaatttcttttacagctatttcattattggtgtatagaaacactactgatttttgtgtgttgattttgtatcttgcaactgtactgaatttgtttattagatctaagaattttttggtggagtccttaggtttttctaaatacaagatcatgtcacctgcaaagagggacaatttagtggttagaaagtcgtgtgaggaagtaaccacttgagccaaagccagcccacgaggcacaatttgccttccttttttccatttagattccttttatctctcttgcctaattgctctggctaggacttccaatactatgttgaataggagtgctgaaagtgggcattcttgacttgttgcagttcttagaggaaaggctttcagcttttattcagaatgatgttagctgtggttttgtcatatgtagcctttattatgttgagtagtgttccttctgtgcctagtttgttgagagtttttaatcatgaaggacgttagattttatcaaatgctttttctgcatctgttgagatgtatggtttttgtccttcatactgttgatatgatgtatcacatttatttgtgtatgttgaacttatcgttgcatccttgggacaaatcctacttgatcttggtgtattatgtttggattcagtttactagtgttttgttgaggatttttgcatctatgttcgtagggaaattgacctgtagttttctttttttttccttgtgtccttgtctggttttggtattagggtaatgctggccttgtagaatgagttaaggagaattctcacctcttcaattttttgaaatagtttgaggagaattggtgttcttctttataagtttggtagaatttagcagtgaagtcatctgatcccagcatcccaaagatgttgggagactttttattactgattcagtctcattgcttgtcaattggtctgtcaaggttttctatttcttccttattcagtctcgataggttctatgtgtccagaaatttatgcatttcctctagggtttccaatttgttagtgtatagttgttcataatagtctctgatgatcttttgtatttctgtagcttttgttgtgatgtctcttttcgtttgggtagttttcagctattttgctaaataggtttctctgcctttggccttcttttcatcttttgaaacatccaaaatttgtatatttgtttgctttatggtgtctcatatgtcatgtaggctttctttattcttttttttttgtctgatgggggctatttcaaaggacctatcttccagttctgagcttctttcttctgcttgctctaatctattgtgaagctctcaaaggaattttttatttaatgcattgaattcttcatttctagggtttctctttggttctttttatgctatctatttctctggtgaatttctcattcacaacctgaattgtttttctcatttctttgtattatttatctgtgttctcttgtatctcaccgagcttctttaatatcattattttgaattctttttcaactatttctttttcattggaatctgttgctggaaaattatcgtgttcctttggaggtgtcacatttccttcttttttcatatttcttgggtctttacattgatgtctgcacatctagcataatagttgccgcttctaattttttggactggcttttataggggaaatcttttttttgaagatgtatttatgtgttggttggataggatactttagctttgattctgagtgcatgaagtagtgaagtttctctatgagttatttggctgtaaacagtgtcattagtgtttgtaatttcctcaatggcttaggctgcagttgttgtttgaggctgtggtgaggttttgctgtggatgaggacgccaggtgggccagtcctcaggccccagcgatggcagtagagggccgagcgtgcctgttcttgggcccatggtcagtgtatatggacaccggtgtcatctggtccaaactggctgaatttgggcttgcaggtggcttgataggatatcagcagtggcagtggtgggctgggtgggcgggtaggtccttggttctctgggtggtgtgtgtggtgtaggtgatggcgctaatggtgataggacgacttttgggccccaaagcagcatgtgttcatgttaacagtgcctgcaacaggctgggtgggccagtcctcaggcccccaacgggtatgtgccagtgggtgctggctgagatgacagcggcaggctggctgggcccatcttcaggcctccaggaggagtgcatagcagtgatggtcagggcggggcagtctccaagctcccgggaggtatacttgggcaatgagagagcagtgccagctagccatgcctgtcctcaggtccctggtggtgtatttgggcactggctgtggtgggcagggtggggcaataccctggacccctggtgcagtgcttgggtggcagcagcagtggtgagcaggcagagcaagtgtgtatgcaagtgtgcctccgtactgctgcttgggagagctgcagccacagacaggcagttctcaggccctggtgggggcatgtgctttagcccctggtggtggcggctgtggtagcagcagggaaaaccagtgtgcaagtacgcagaggtggccttgcttctgggggtggggggtaattgctagtggtgcacacttaggcccccagtggcagctgctgtgggcagtgttagagtctgttctcagagtctgtgtgaaggagccctgctactgtggagggattaaggttgctgtcagtagtagtcctcccaggtaggtggttcttagactctatggagcacgtgctttggctccctttgtcctggatcggggtgggcagcctctccaatgtgctgcaccatttgttccccagggtgcaggacactgtgtatggtagagtgctggggatcttgccacttcgctgggtctaatggttgttgtgccactgcagccctctgggtggatgttgggagatgttggtggggctctagggatgtggagatgtaggggttgttgggcttcagggcaggatgcagtgtggtgggggctgaagtctcagaatggcgctgtgctacagttgcttaggacttgggacgtgggctcactttctagagcaatgatgttgcatgatctctaggcaggtccttaagctgttctcagggcctgtgatgggtttttctgtggctagggctggcggagtccatggtgggaatattgaccactgtggatctctcacttaccctttcccctcactgaagagcctcttcgggctctcagccagtcttggccaaactggctgtcttgcgttcctctcttttcatgcctcgggtgtttcctcttacttcttagattccagtgttccttcttagatgctcagtttgaagattatatacttaatattttggttcttctttgtggagaagaggaatattggaagcctccagtcagccatcttgaagtgatttacctattgtatctttaaaaaatctcatggactattactattattacttacatagtcaatgtttgttgagatttacccacatatttagcatgttctttgctttttattcttgacatctcagacctttcatctgggattacttttcttctttctgaggtagatccttcagaatttcctttactgaaggtctgctagtggcattctgtcttggtttatgttcatttgaatatgtcattatttcagctttgtcctcgaaagacactttctgtgatggtaaaataccaggttggcagccattctctttcagtacaatgaagacattcttttgacttttggtttccattattgctgttgagaatacagctgtcagtatttctcctctgactgtaatctgtcattttaaaatctagctactttaatcttttcatgtcatctttggtgttttacagtgtcaccatggtagttctgtttgtaggttttgttgaatcttgatgtcttggcaaaaccacacatatacaaatacactgtttactttcattgtgagaaattaaggatttcagatggcacaagtaattcaaggttataaagcagttttcttgatagccttttgaatattgagtacaaatagtccaaaccatgttaaagtagaatttggaagcagttaagagtagaaacaaatgtatgcccactgctgccacaatctgttttataaatattcccagaagtccccagaagaactttgggattctggggaaagtatggttaaaaacttgtagttggcgttcacccaaagataatgcatgtgtgattcattttgctttttttcaggcatcgcttattaattatggataggttaatagtggttagtacagtgaaatactctttttgagtagagaaaacatttaggcaatacaccatttatttagatgtcagctataaaataaaagtacagttttttagatataatttgtatattcttgaaagcaaaatatttttctaattatttttcattctaatttttaacataacaattttcttctaatagaaaaagtaaatgctcaaagcaaaatattgggaaaagcttttggatacaactatcgcaagcagtgtggtatttggcttcatactacttttcttttctcttacacatataactttagaaaacacacacatggtcaaatcagtggagaaatgttgaaataagttatggtatagttgttctttagaataattatagaataatttagaatgagagtgtttctagttatactaagaaggaaagctctctaagatatattaagtgaaaaaagtaagtcccctcaaatatatacagtgtaatactgttatgtcaaaacaaaataaatatgtatttctatatgtacctttagaaatatgtgtgtaaatatgtaaaaaaaatctggaaggctatatatcagatctataatactgattatttctgcgaaggatgttgaatggtaagggaagtggtaatggggacttttgcttttatctgtggcttttttttaaaaaaaacaagaatatatttgtatataggatttgtgctttaaagtaaataaaatgacaattttcgtttgaaaaggggttattgtgtatattctgctttcttgcctattttttttcataatctgttgtgactgtattcccatgtaaaatatctctataaattgaaatttatgtctgcactgcattccattgtatggctgttccataatttacttaacccaatctctattttgttaagcatttagaatatttccagatttgttattaaactagatgatatgatgaatacttttatgtatatgtctttgtatacctctctgtttccatagataactttgctaggttaaggggtatgtttttaaggctgacaagtggtctttcagaaaggtatacccatttccgccaacctcagaagtaggtgaaagtgtttttttcctactctggccaaccttgggaattatttttcttgttattttttgctaattaaaaaaacaattgttttccaaaatttcatttcttagattactagtgagattgaatctttttctttccatgttttttggtcattaatattcctttatagtttgcctgctaatcaccttttcccatttttctcttagcgtgttttttcttattgatttgagtgcttcatttattgcacatatcaacgctgtgtcataaaagtaaaaacttttttccagtagtttgctttttaatgttaaagtttttttaactgagagaaatattatttattgacttgaatgttaaatactttaaatgtcttagagttaaataatttcaaaaggcacacataatattaaattaattgaattccataaattaaaaaaatctgtatttttgtttattttgaatgtttctattctttttttttaaacacatcattcaaatgacaatactttgaatatttcttaaaaacactggaaatgtttgctctcaacttttatataacagcttttccaaaatattttaaggtcgtagcacttaaaactttataattaataactaaagaaatacagttgcctagtttcttaaaaaatgtaacgaggcatctatgaatgctccttgataggactttacattaaataaatgtttatttaagctttactggtttccttttcaaggatagtaataaagtttaatttactttaaaactttttctaacaatttttaaaaactgtgtaaatacttctgtgatcagaaacagcaaaaatttgcattaggcttattaatggtagaaaaaaatcactgagaaacttacttggatagaaaattcagcaagctgtgtggctttttccctcttgtttatttaagttttcttttcttagctcttgttatgaccctacaatctttcaaagcccttagcttctggttggtgctgtcacagctcatcagatttactcacgagacccgtacagagtgtctggtgaaaaagaggaaaggaacatatgtgctgctgtgtccttggcaacttgcagaaggctgaatcacgcaaatgaaaacgaggcccattgtagattttcttcttgcaaacttatttgatcttgccgttttccgttttcaacgtgctcccccctcttctgtatcttatattttagttctctctaaaaaataatagaaatttaggaatgccctgtaagctaccgttttttccctcatattgccattcccatgtctccagtgcatatatacttataggagtatatggccagtcatttcattaaagtccaaatatttaatacatgaaagagcaagacaggataatccagcaacttagaatcagaactaggactaccttgttttgaaggctatgtgaaaaatttttttaaaatctcttatttttcttgtcttttttggggaaagtttgtaaactcattactattttgtctctataattttatttattaacataataaataaatacaaattattagtctttggagaaattagtcttttgaaaaactaagaagtaaaagattcttttaaaagtttgcccccagtattaattgctttcattattatgggatgttcaaagtttttaactttagcttcagatttatgtatcattgattgtaacttaatgacctacactggtctgaagtgtcatcttgtagcctaattctttaagcaattgtgaccttacagactaggaaggagggcaagcagcaaacttccagatgccgagtataaggttgcaggatcccaagggtatagaggaattcttctggtccaaagggaaccgtggaggaggggaaaacctagaatcaggaaagtgtagcaaagcattcctgtcctttggcatcgtaggctgccagtgaccatcttaactctttttgataaaaccttcccgtttattgggtcttctgtccccctacatctcacagatacagctttatttagaattggaactcagtggtaacatggcatttccttcacaacttacttaaatagaccttaaaggtaattaattattttgggcagtgttagctgcttctttgaatgctggtttattttatgggcaagtatgtgtgtggtttagttttttcttaattaaaactttaagggagtgggttttaaaaatctaaacgtttgatgttttaaaaaaatgtaactggtcactttagtagttttttttttctattttgaaaaactctaatgttttccttcttaactgtttcaaagtttgtcttttgggaatttttttgttcagcaaacaagaaataggtctactttccacactcccatcccattctcatttttaagaaaacaaaactagaaattgtggctgctttttgctctttgttcaggtatgcgcagagaggagtatgtggtatctgtaacttgtgcttcatctctctaaattttaaaattaagattttatagcttttaatgcatgtattcaccaactttctccctgtttttgtaggactgtgtatgttcagttacagccacataaagcagcactttttatttttctgtgtaacagtaggtcaaaagtggcagaggtgcatataactaaggttgtaaaaagttcgaggtgtgttagtcccactagaaggcttctgaataaacacttgagtatttacgtagatttttgcccttaatgtagtttataataaaatatggactaatatactgagtatattcagtactcttgtttggtataaatgaaatggttagaaatgctgtcaacctaaatgactgactcaaaagctatgaaatttaatacagctgatattttctttttcatatgaacagcttggaacaaatgttttgcttgtgcaaatgagatggctattatgatgcaaagaagcatcttggaaaaaaaatttcctttttctgttttaagtgttccagctaaatactgcaacaattgcaagcagagtctggagatttttctttcttgcttctgttgtatgatatattttagcaagttctcttgagactattaaaatgtcttggtttttaggacatgtgatcaggtggggataactttgtctatagatgcagtgggttagcagttagattttgcatgtcttctcatttctttctagtttctctgaccccgggtaacctttggaaggacctttggttcttctgaaggcaggagtgaaggaggtttgagcaggtgactgatgatcactgtctctacagtccacagacaatatacgaattactttagcagtccccttagtcccctcctcccactcctccccccttaaaccaacaaatgcaaatagcttcatccccatttgctagaaattcaggcttgctcaggcaacatgggctttgttgacttgctttctccagaaaggcaattttattcctggtaaggagcaaggctatcctatcatttggaacctaaatcaccttaacggtaaaaacagcaacaacttgtttctctggaatattgataaaggtacgaattactgcaaaagtttttttatattgtaattgaagtgtggttaaagaaattcattgtctgctttgttagcttttgtatactaaatatctcggtaattttggttatctcaaagatgtcctctgttttgttctaaatattacttattgaaattgttggcactattatttgaatagtcacttctaaaaattgttttatggtacagggaaaagtaagcctttggttatttctaccataaaaatgtttttttttctttttaaaaagaatagtcctattgtaagtcaagtttgatcatttaaatcaccagtttgtaatgacactgttgtcattttttaaaaaatagtttttagggatgtgacagtaaatgcttttttactggtattacctgagatttattaaaagtttttttatgatacaaaaatgtgaataacattttactaattaaatatattaatacatctgatgtgtttttttggaaattgtagcagagacagctaagatttttttttaacagtagcataatggaagttactctgtagaaataatttaggaagaaacaagatactaaggtttaaaaattgagtggcttttaaaagctcatgttgctagatgaattatgaattgacctaaaacaactgaagttgcttctttttgtgtgaactttcttctgaaaatattaaaagctatggagattatcatatttttaataatgtcattttgaccaaaatcttggttcttttgaagtaagcacatatgagtagcaattgtgaaataaaatagtcttcataagaagcatcccccatgaggctgaaggggggagtagtttacaaatagtgtcagtggttgattggcaagtagaaaacaaacatgttttaaaaacaagattcttagagcctttctaaattctaattgtgatttctagcttgttcttgcatttttatgattttctttctaggctgaatacttatggggatataattatataacagggtagggaaacgatgtaaattttactaaattagattttcttattttaatttagcatatatgccaacttaaaatggcattgtcacttaggtatggcggtagagaacaactttagctggtcttttgtttcttaaacaaaatacaggttagagaactatcctttaatgtctcattgggtttgggaaatttttcccagtaacattgcaagattccagtaaccttaagatagaatattctatgcagattaaggtataatgttttataagatatatgaagtgtttcttcttccttctttaatctgtttatcttaggtccccaagccctgttttgaagtgggggaggagggagtgaatcaaaactatagatcctttcaatatatttggttttggtttagttacccagacctaatttttaaaagctgctggaaaagacgtaacagcgcttcctaatgagaagttctgtcagacccccaaagcaatctaatttaaacgaaatctttacttttctgagtgagtgatttctttctttttgtgtcggaattgctttttattatatgtgttaaacatgtaatttttaatactgtaaaactgatatctttggtgttgagagggaaacctacatggaccatcaaggagactcaggaaggatggtgaaggagctaaggcagcagattctgggcttgttttagctcttgaactctggccatgtcatccatctctgcttgatagatgaagagaaccctctggttcaaatagggaaattggtgcaaggtccaacaagggttaaaatatgaaaaggcaggtacaatttttataaaaactggaacagctaccactgaaaattaaagactgtgttttcctttgtaacttcatcccttttccttgtggtgatcagttgcaaaacaaatctttgaaaatgaagggaggggaacaaaagggccttttgtgctcgttttgggtacagtaggaagtgggagaaagaatgaaaaagtagtatctcagagaagtttttaagtgatgatacaaggaagagtgctaacctgtgggaggcaaggttgaggtgtgggagggatgtctgactagaacagaggatgccctgttactatgcatggaggtagacactgtgtgtttctgacggtcagctacttgggcaacagaaatgcttttaccattatgttctgctgagtcagtttctttgaatgattactgcctgtagtactgaggtgatctattctttaattctgaaattgctggagactgagttgcagattattgtgttttatttgtgaggattctaaaggtcactgctggcatgcagtgagcctgcgtgggtatttctaatgttatttttaataggttcacatatgctagtctaaaaattttatagctgtttatctaaatagaatattataatgctaatgttaaatcatcattttctttagagacatctatgtatttagaatggctggttctattgttactcaaagaagtggctaagttgtttgtttttttggggacattttgtatttttaatgacaaaattggtatgtattatagaacatttagaaaataagtgataagaggaaaatctgaaaactacatgtattcttgccatctgtagattatcactgctaatattttggtatataaggattagaatattttaattaaaaatcaaattttaattgccagtagtcattgagaccaattgagggcatcttttaaaaagcatatgttgtattctattctatgtacacagaattgtattaatttcatctcatctaattaggtattcttattctgttattctggtagctaacagacttaaaatgtggtccgattgtaaatatatgaattagagaaattccacaggaaaatttaaattgtcaagaaagactatcagaaggtactccaccaatatttggtgcaatagtttttcttaaaggtatatttagtcaagagaattgaaaaaactcaatttttttgaggaaaaaacaaaaaactaaagcacctaaacatggacttattatttttagatttcagcttttattttagatacagacggtacatgtacaggattgttacatgggtatattgcatccaggtagtgagcatagtacccaataattaatttttcaacctctcctcctcctcacccccccgtagtctgcaatatctattgttcacatgtttatgtccatgtgtgctcagtgtttagctctcacgtataagtgaggacatgcagtatttgattttctggtcttgtgtttatttgcttaggattatggcctccagctccatctatgttgctgcaaaggatatgattccattcttttttatggctatctagtattccatggtgtatatgtaccacattttctttgtctagtctactattgatggccacctaaattgattccacgtctttgctattgtgtatagtgcagcaatgaacatatgagtgcatgtgtctttttggtataataatctgttttcctttgggtatatactcagtaatgggattgctgggccgaatggtagttctgagttctttgaggaatctccaaactattttccacaatggctgaactaatttatgtccccaccaacaatgtataagtgtccccttttctctacagccttgccaacatctgtttttttttttttttttgaggcggagttgcgctcttgttgcccaggctggagtgcaatggcacgatcttggcccactgcaacctccacctcccaggttcaagcgattctcctgcctcagcctcccgagtagctgggattacaggcatgtgccactgtgcctgctaattttgtatttttagtgcgagacggggtttttccatgttggtcaggctggtcttgaactcctgacctcaggtgatccacccgcctcagcctcccaaaatgctgggattataggcgtgagccaccacacccggccacgtctgttgttttttgactttttaaataatagccattctgactggtgtgagatggtatgtcattgtggttttgatttgcatttctctgataattagtgatgatgagcattttttcatgtttgttggccatatgtatgtcttttgagaagtgtctgttcatgttctgtgtccatttttaaatggggttatttattttttgcttgttgatttaagtttcttatagattctggatattagacttttgttggatgtgtattttgtgaatattttctcccattctgtaggttgtctgtttattctgctgatggtttctttggctgtgcagaagctcctttgtttaattagctcccacttgtcaatttcgttgcactggctcttgaggacttagctaaaaattctttgctaaggccaatgttgagagggtatttgctaggttttcttctaggatttttatagtttgaggtcttacatttgaatctttaatccatcttgagttaatttttgtatatggtgaaaggtaagggtttagttccattcttctgcatatggctagccacttatcgcagcaccatttattgaattagggagtcctttctccattgtttgtttttgttggtcttgcacaagatcagatggttgtaggtatatggctttatttctgggttttctgttctgttccattggtctgtctgtttttgtaccagtaccatgcttatagtatagtttaaagttgggtagtgtgatacctctggctttgttcttttttgtgtaggattgctttggttatttgggctctcctttggttcggtatgaattttagaatagtttttttctaattttgtgaagaatgacactaatagtttgttagcaatagtgttgaatctgtaaattgccttacacagtatggctgttttaatgatattgagtcttccaatccatgagtatgggatatttttccatctatttgtgtgatctctaatttctttctgcagtgtttatagttcttcttgtagaaatctttcaccttcttggttacctgtatctagatatttcattttccttgtggttgttgtaaatgggattgtgttcttgatttgactctaagcctggatattattggtatgtagaaatgttactcatttttccgcatggatttttatatcctgaaaccttgctaaaataatgtatcagttctactagccttttggcagagtcttcggggtttcctaggtatagaacatatcatcactgaagagagatagtttgacttcttcttttcctgtttggatgctttttatttctgactgttctggctagaacttccagtactatgttgaatagaagtggtgagagtgggcatccttgacttgttccagttcttaaggggaatggttccagcttttgcccatttagtatgatgttggctgtgggtttgtcatagatggcacttattattttgaggtatgtttgtttgatgcccagtctattgagggtttttattatgaagagatgttgggttttatcgaaagctttttctgcacctattgagatgattgtgtggttttgcttttaattctgtttatgtgttgaatcacatttattgatttgtgtgtgttgaaccaaccttgcatcccaggaataaagcctgcttgatcgtggtgaattaactttttgatgtgctgctggattcagtttgctagtattttgttgaggatatttgcctctgtattcatcagggatagtggcctgaagtttttttttctttgtcatgtctctgccagattttggtattaggctaatgatgctagcttcatagaatgagttcaggaggagtccttccccctcaggtttttggaatagtttcagtaggattggtaccagctcttctttgtatgtctgatggaattcggctgtgaattcatttgttctggggcttcttttggttggcaggttttttattactgattcaatttcagagcatgatattggtctagtcagggtttcaatctctttcttattcaatcttgggagattgtttgtttccaggaatttatccatttcctctagattttctaatttgtgtgtgtagagttttgttggttttgttagtttgtttgtttgagatagggtctcactttgtcacccaggctggagtgcaatggcgtgatcttggcttactgccacctcaacttcctgggctcaagtgatcctctcgcctcagccccacaagtagctggaattacaggtgtgtgctactatgcttggctaatttttgtattgttaatagagacggggttttactatgttgcccaggctggtctcgaactcctggattcaagcaatctactcacctcggcctcccaaagtgctgggattacaagtgtgagccaccgcgcccggccttgcatagagttgtccatagtattctctgaggatcttttatatttctgtgggatcaattgtaacgtcatctttatcatttctgattgtacttatttctattttctctttttttttctttgttaacctagctagtggtctatcaatcatgtttatttttgcaaagaacaaactcttggtttccttgatcttttgtatggatttttgcgtctcagttttgtttttgttttttttgagacggaatttcactcttgttgcccaggctggagtgcagtggcgcgatcttggctcactgcaacctctgcctcctgggttcaagtgattcccttgcctcagcctcccaaggagctgggattacaggtgcacgccaccacgcccagctaattttgtatttgtagtagagatggggtttctccatgttgatcaggctggtcttgaactcctgacctcaggtgatccacccaccttggcctcccaaagtgctgggattacaggcgtgagccacagcgcccagcctatgtctcacttttattaaatttgcctttaattttagttatttcttttttctgctagctttgggggttggtttttttttttctttctagttcctttaggtgccaagttggatttttttttttttttttttgagacagagtctcactctatcccccaggctggaatgcagtggtgcgatctcagctcactgcaacctccgcctcccaggttcaggtgattcttatgcctcagcctcccgagtagctgggattacaggtgcctgccagcacgcccggctaatttttgtatttctagtagagacggggttttgccatgttggccaggctggtctcgacctcctgacctcaggcaatccacctgccttggcctcgcaaagtgctgggactacaggccggagtcactgtgcttggcccaaagttagatttttaatttgagatctttgtaacttgttgatgaaggcatttaggactataaactttccttttaacactgttttagcagcatcccagagatttcggtaagttgtttccttatttttattaatttcaaagaatgctttgatttcagccttaattttggtgtttacccaggagttattcaggagcaagttgtttaatttccatgtatttatgtagttttgagagatcttggtagtgatttctatttttattgcactgtggcccaagagtgtgcttggtatgatttcagttttttttagttttattgagacttggctttatgactgagtgtgtggtcgattttagaatatgttctgtgtgcagatgagaaggatatatattctgtggttgttgggtggagtattctgtagatgtctattaggtccagttggtcaagtgttgagtttaagtctagaatttctttattagttttctgcttcagtgatctaacactatcagtgaggtgttgaagtctctcagtattattgtgtggttgtctgagtcttttcttaggccaggaagaacttgttttatgaatctgggtgctccagtgttgggtgcatatatatttagcatagttaagacttcttgttggatcataccctttatcattatataattaccttcattatcttattttttattggtttaaagtctgttttatctgatataagaatagcgactcctgttcttttttgttttctgtttgtgtgatagatctccattcttttactttgagcctatgagtgttgttacatgtaagatgggtgtcttgaggacaacagatggttaggtcttgtctttgtattcagcttgccattctgtgtcttttaagtggagtgtttagcccatttacattcaaggttagtactgatatgtatgattttgatcctgtcattgtgttgttagctggttgttatgtagacttaattgcatacttgctttatagtgcctgtgggctatgtgcttaaatgggttttcgtggtagcaggtgtcattctttcaatttcatgtttcacactcccttaaggatctcttgtaaggctggtctagttgaaatgcattctctcagcatttgcttgtctgagaaggattttatttctccctcatgtatgaagcttcatttggtggcatatgagattcttggttggaatttcttttctttaaggacactgaaaataggctcccaatatcttctggcttgtaaggtttctgctgagggtctactgatagtctgatgggattccctctgtacatgacttgacccttatttctggctgcctgtaaaattttttcttttgcattgaccttggtgaatctcataactatgtgctttggggatggttgtcttgaccgtctagctggtgttctctgtatttcttctgtttgcatgtcaacctctttagtgagattagggaaaatttcatggactgtatcgtcaaatatattttccaagttgcttattctctgtcctctctcagaaatgctagtgagtcatagatttggtctctttgcataatcccatatttctcagagattttgttcgtttttaaaaatcattttttctttctttttgcctgactgagttgattcaaagaagtagtcttcgagctcttgagattctttcctcagcttggtctcttctacttgttaatacttttgattgtattatgaaattcttgtagtgagtttttcagttctagaagttcagtttggttctttcttaaaatggctattttgtctttcacctctcacattgttttactggattttttggattggatttcagctttctcttgaatcttaatgagcctccttgcgcatccggattctgaattctgtgtctgtcatttcagactgattaagaaccattgctggggagctagtagactcctttggaggtaaagaggacactctggctttttgaattgccaaagttcttgtgctgattctttctcatctaggagggttggtgttcctttaactgtggtgtaagttgagtatagtccattggcttcatttctggatgctttcaaggggccagtgccctgtgcaggatctttatgtgtaggtgaattcttacatttgatttataggtgtatttattagcccaataatttttcgttttgtagtttgtgctgtgatccagtagatggcacttgacagtaatagctgtaggttgttaggttagtacccatccacgcttttgtacttcctcgtgtccacaggcatgctctatagtggggtacagaggaagagaagtggtcccctcccaggtctgctcctgggccttgggggagccccctctgatgactgttgtgcttgtgattcttttgttaggttttccaggttgtggtgtcctgtcgggcaggggttgcagtggagaaatacaccacaccccttctggaccggccctccgagggaggcacaccctgctcccgccctggctcaggaacctacatgtcttgcccctctcagggctctgagggtgggtacccctcctctcctcgagtggcagccacagatctcagctgtatactccctagttgcaggctgcagccgtggaggaactggaactttccgtggctcctggtcaggttccagctgtgctgggggatctgatgtgcttcttggttgctaggaaagtaatcagttgcagcaaggcactcaggctgggctgcaggggctgtgccgtgcacctgctcctgcacagtagctaggcattgggcctgggaggggctggtggcaggagggcttgcagagcaggcatgctccagtcccatggggaagctggcccagctctctcctggctcagagatcagctgggtgtctgtggctgctctctgccagagctgcccagcacataaaacctcctgggctctgcaccatccaaaggcctgtctctgcctccttcccgggtagatccccctgccaattcacatgtccatgggggatgcagggtcctctgtagctaaagtcacagaggtccgtggccagagtgagttgtccttcagttcttttacccctttctcaggagctgttcagggctgggagctagccttgcattcgggtaccctgtgcagggttcccagcttcctccctcttcagcctttgcttcagtggtgcctatccattcactcttggtgttttctccccaaagatctgcccaaattatggtgctttagttgataatttggtgtctctcttttattatttatttaatttcaaaatcgggtctcactctgttgcccaggctggagtgcagtggcatgatctcagctcactgcagtctctgccttccaggctcaagtgatcctctcacctcagcctcctaagtagctgggactactggcgtgtgccaccacatctggctaatttttgtagagatggggttttaccatgttgcccaggctgatgtcgaactcccgagctcaagtgatcctcccgcctcggcttcccaaagtgctgggattacaggtgtgagctaccacacccagctaatttggcctctcttggtgggaacggcacttcctgctgtgtctagttggccatcttctcccctattacactggattattaaggaagggcatgtcgatatttgttttctgtactactttgttctttttttttgtggtttatgtaagctccctcaaatttgaacgtgaaaaacatatttaaccaaaatatttaattctgttttatgtttaagtttatagaagaaaatattttgattaaaagatctcttttcattttcctcctcattaattaaaaatagtacccagtttaaacaaagagcataagcttttgggtaagacagttctgaatttgaatcctagttctaccacttctagactaatgtgtgatactgggttgggtggttacttatcttgctgagcctctgtttattcatatttaaaatagagataacacttgcttcacaaaattgtaaagacaaattttaatactatatgcagagtctatggcacatttgaggtttgcaaatttccttcctggacctggcatggtggctcatgcctataatcccagcactttgggaggccgaggtgggtggattgcttgaggccaggaggttgagaccagcctgggcaacatggtgaaactctgtctcttcaaaaaataaaaaagttagctgggtgtggtggtgcatgcctgtagtcccagctacttgagaggctgaagtgggaggatctcttgagcctgggaagtcgaggctgcagtgagccatgatcacaccactgcactccagcctgggtgacagagtgagaaccttgtctcaaacaaaaacagaaacaaattttcttccttgtttttatttatcccaaggttggtttttttgtttgtttttggttttttttttttagatgtggtgaaattcacataacataaaattagccattttaaaacgaacaattcaagagcatttagtacattcactatgttgtgcaaccatcacctccattttattctgaaacatttttatcaccttaaaagaaaaccctgtgcccattaaacagttgctccccatttctttctcccccttgcccttgttaatcaccaatctatattctgtctctatggatttacctattctagatattaatagtttgtgtaaatgggatcatacaaggtgtgaccttttgtgtctttcacttagcataatgccttcaaggtttatacatgttgtagcatatatcagtacttcattcctttttatgactgaatactattcctttgtatggatatgtcacaatttgcttatccatttctccgttgatggacatttaggctttttccaccttttggctaccgtgaatagtgctgctgtgaacataggtgtgtatgtatgtatgtcaatgtatgtatacgtatgtatgtatgtcaatacatacatacacacccatgttcatagcagcactactaccatatgagctaccaattccactcacatatatatgagtacgtcttttcagttctttgggatctgtacctaggagtggaattggtagctcatatggtaatttaatttttttgaagaactgccaaactgttttttttttttttttcttcttgagactgagttttgctctgtcacccaggctggagtgcagtcgtgcaatcttggctcactgcaacctccgcttcctgggttcaaccaattgtcgtgcctcatgctcccgagtagcggaactacaggtgtgcaccaccacgcctggcggatttttgtgtttttagtagacacggggtttctgttggccaggctgatctcgaactcctgacctcagctgatctgcctgccttggcctcccagagtgctgggattacaggcgtgagccactgcgcccggctgctaaactgtttttcacagcagctgcaccactttacattctcactagcagtgtacaagggtcctgatttctccacatccttgccaacggttgttatttgtcatcttttttattatagccatcctagtgagtatgaagtggtacctaaatttgcagttcttccttctgttttgaatatattctaaaaattaagttggtcgatgagtatttgaagcttacttttgccaagaaaatggtaaaatgttacgatcaagctatagtagtcaatttaatgcataaacaccctgaattgtttctatgagaacataagatcagagacaaaacctgaattttaaacagtcattaacattaacaatcagcaaacatttattggatgcacattatatggtaggccctagaccagatatttgagatataacagtggaacttaacatagttccttctcctaagggaactcacagtgtggtgggacagatagatatatgtaaataaagataagatgttataaggtctatgccaatagagataaatacatacagtatgtgtgctgtgtgagcatcatggtcctatgtttgcctgggtaacttattgctagaattttacagagctggtagttgagcagaatttcaaagaatgtgtaatagtttagccattgacaacaaggaagggaagccctttcctgaaaggaggatcgatctctgtgaagacagaaagagtgagaatggaagcctgagcagatgttgacgaaaagtcaaattctgtaaaatgtttgaagaggtttattctgagccgaatatgagtgaccctggcatgtgacacagcccccaggagatcctgagaacatgtgcccaaggtggtcagggtgcagcttggttttatacattttagggagacatgagactgcaatcaaatacatttaagaaaatacattggtttggtccagaaaggtgggacagctcgaaggtggggggacttccaggtcatagagttaaaatttttcgaattggcaattggttgaaagagttatcagtaggaagaaatgtctgggttgtgatatgaggttgtagagaccaagttttatcatgtagatgaaacctgcaggtagcaggcttcagagagaatagatcataaatgtttcttatcagactaaaggtctgtgttgatattaatgctggagaggtataacgaggcatatccgacccctgtttctcatcagacctgaaccagtctttcaggttaaattttaaagtgccctatcctagggggaagtccattccgatggttgggagtggggcttagaattttattttttggtttacacagatgattatggcagaatctataatgacagctgggaaaaaagatggggctatgaagatacacagagggcagatagtagagggccttagacagcagaccagggaattaagattttagcatgtaggtaatgtggcatcactgaagagtttcaagtggaaaagtgacataaatttgtattttctaaagatcatgcttatgggctagagtatggatcagaaagggcagcctggaatggcaattaagaggctaatgtagcttatgtgagaggttattgaagcaggatatttccctgaccccttcatgggtgggaactggagtgcactagctggctgctttggtgccggcaggggcaaactccactcacttggacctgctacattccaccccttgtgggaagaggaacatacaggtgggcaggtgcaggagctggggcgagtgcttttgggcgctggaaggagtgaactccatgggggccccatggcagcatctaggggggtacctgtgacccctgaagccccagagggagtgttaacagtcagtgttcttttagctctgccatccacagatggcttaagtgttaacagctcagtggagggtcagtgtgacagccttttgcactcgcacttgtggcacctgagttcttgtctggcatccaggaggaatgaggttgcatgagtgaatttgaagtatagtaaatgtgggggattttattgctgatggaggtggctctcagtgggatggggaattgaaaaggggatggagtgggaaggcaatcctcccctgaagctacactggcaagctgtccctctgaagtgaagccgcttctctgtgatgtccaaccatagtctctgaggtccagctacttctcctcactctgccagctgagactggggtttttatgggcacaggatggggggtaaggggggccatgggtggttttggaaaaggcaacatttgagcagtaaaacagagatgtaagttctcactttgggccatggtatcaagctttttggcttgagggtaaggcccttgctgggaacccaccctcccagaatttctctgcctcctgtttctatcattatgaggtcctgaatcaagtcattgacaggcatgaataacacatctgggaaatacttgggaggtaggcttggctagacatttggagggaggaagcatacaaggatgacttcaagatttctgacttcagataggtaatgtcgttcatcaagatagagaatttaggataaacaaaatgaattctacttttggaaatgttgaatttgggatgcttatgtagatatctagttggctattgaaaacatctctggaacttgcaagaggcctatgctagagagagggagagagagtatgcaggcatgtgcacaagtatgcatgcacttgagcaggcaagagaacgtgagagtgaatgatttggtaatcattactataggcagtagctgaaataatgggactgaactagagcactcaaaactgaggtggggatgggggagaaggcagtcaatcatgaggaacactactggaaaagtgacggaagtaggagggaactcaggaaagagttgctatgtgagacttaaagaattttgaaaagaaggcagagtgtctagtgctaaaaatcaagtaagatcaggaagaggcatccattgtcaatggctgttaggaagttgttggtgatattaacacacaaaggttccctaaaaggttgtatctgtggaaatgttgttatagcaggttaaaaatgagaaaatcgtaataatagtgaacatggactagtctttaaagaagcttagtcttaaaaggaaatagagaaggtattagctggggagagtgtaggtaagtaggatttccttctttggaggaaacttttttccttccatttgtcaggcagtggcggcaagccttccccagtctctaatccattgatagaagagggcaaggaacacctttagggcctgggaaaggagggtaggaatagagacagggatggtgatgtgagtgttgctgctgttgattaaatgtgccacgtgcaaaatttaaataatctgccccaaatctcataggaggtattgtgtggcgaagctggatttgaacctaattagtatggaaccagtgttcctacaatagatagtgagaagcagggaaaggaatagctgtaaagagcaattggtaacagagccccatgtccatgtgatctctaccccacctcttctgagaaaattcttagtgttcagctggcttctgacttccagatgcctgttgtgataagtaccaggaacatgcttccttgttttcctttccactggtatctaccccttgtggtttccttctagagttttcctcagcctttgaggtgttcttaaagggtattttgttgttgctgaaaataaggaaataaacatacatttaaaggacttctatgcttatggagaggtaaagtcactcttatctgacagtaacagtccttgagtattcaaaaggtattttcagaggaagagcagacttggttgttacgaatgtttaattcccaaagcaaggttgacctctgggatgggacgagtggctcttctgatacaggtagggggaagggagagaagaaatagagcagtatctgaagacaccagtcaaggaagccagtgttatggtatgggatggcagcaggagcaaatgaaggaagctcacggggtttatacctgacctacctcccctttgctcttattgctgcccatgattgattagtttgtggcaatctgggttctgtgggacagggagcaaagttccaagcagaggcattgggcagcacagctgagtgtatatgaactctaggcttcctttaagtgaaaaggtgaaagttgttgactgaataaggaaagacaaaaatcatatgcttaggttgccaaggtctacagtaagaacaaaacttttatctatgaaattgcaaagaagggaaaaaaaattcgtacatagtatatatggagtctgatactatcggcagtttcaggcatccactgggcaggggggtgggggagcatctcagaatgtatcccccagaatatatggataacggggggatactctgcttgttaatatttttccctataaacatgctttcacatctgattttttttttctaaacaagagtccctgtcagagagcacctgttgactattgactatatagtgaaacagcacataggagttcacaaggttgtccactgggtcattaaaaaaaaacacacacacacatgcatcttgacttgggagtgaatttgatgatggcctttttgttgttgttgttgttgttacaggacagaaagcagagtggcatattggaaaaggcatgagcttaggaggcaaacactcttaaccacatgggtgctcttggctcagttacctaacctcacagagcctatgtttcctcatgtgtaaagtgaggaaacaatatctacctcataggatgtttgggaggatttcatgcaataatggatattgaagtgcctagcatgtaatgggtagccagtaaatattggcacctatctcctttctttctctagtttccctcattccaggcttccagaccccctgttggctttactccttgccttctagattgtttcccaagatttgttaatttctttttcatttccacaattcaataattatcatttcttggatgtttttcttacctggacattttctgttctgtctgaagataagctgaagaaccaggtaaattttgtgttggttgtttacataaaagttttattaaagatgagtagcatatccttctttatatttcacataactttttcaaaaagatttttattcactttgtgaccactatgaacacacaaagtttgtgtgttcatatacatatgaacatataaagttttatatatagttttaaccttatttaaacaaatccatttcctatttcaagtagtttaatactgaatagagtttcagcatggtgtgtgtgtgtgtatatatgtatgtatatctatatgtatgttatatgattgctcctgggagtttaattttgatgtgtaatatattgaatggttactctttcctttttagttgaatcggcttaaaaagtattttattctaggtgctggggatatggcaataaataaaatcgagtccttaggaggctgaggtgggaagattacttgagcctaggagttcaaggcttcagtgagctatgatcacatcacttcactcctgcatgtcggcactggacgacagagtgaaaccttgtctcaaacaaaaaatgaaaaacccccaaaaaactgagtccttgactttgaaaagcctgctttctaaagtgaaattttgttcatatgtaaaaatttttggccgggcgcggtggcttatgcctgtaattccagcactttgggaggccaggtgggcggattgcctgaggtcaggagtttgagaccagcctgactaacatggtgaaacccagtcgctactaaaaatacaaaaattatccaggcatggtggcacgcgcctgtagtcctagctacttgggaggctaaagcaggagaattgcttgaaccagggaggtggaggttgcagtgagccgagatcatgccactgcactccagcctgggtgacacagtgagactctgtctcaaaaaaaaaaaaaaaaatttatagtactttgtttttaactttgctcatacatacatatatgccatacatcaaaaaatttttattataatatagaacaaatatatatactttaggggactatttgaaactatagcttcagttttcaaatgccaaaatagttagatcaaatattgatttcattatagttgccatgttctgtaaagttactatttgctacaatttaactgcttattttatatagaatatactagttttgggggtataacattgacttgcaggctgaaaatatttttcattcgttcattcagtattttttgaggacctcctatattcctaggttctgtcttaaaccaacctggcacaggaatttgaacccagatctggagctcaattattcctcttcttcattctatatatttagagttggggactagaactgtagagatcagtagattggtcaagagaatgaacattttatttgggtttagtaattgtgttagtctgttttcatactgctataaggaactgccccaaactggataatttataaaggaggtttaattgactcacagttcagcatggctggagaggcctcaggaaacttacattcatggtggaaggcaaagaggaagcaaggcaccttcttcacaaagcagcaggaaagagaggttccgagcgaagtgggaagagccccttataaaaccatcagatctcgtgagaactctcttactatcacgagaacagcatgggggaaaccgcctccatgattcaatttcctccacctggtctctcccttgacatgtggggattatggaaattacaattcaagatgagatttgggtggggacacaaagcctaaccatctcagtaactaaaaagaggtcacttaatgaccttggaaaataatttctttaaaatatgtttgggggaagaaaagtttattacaggggctaaggaaatggaataataaggaaattgaaatgtcaagtataggtaattcttcttgatgttttattcatagtagtgagtggaaagagggaattccctcaagggcttgaaagtgtatcagaaacagggaggtaacttcaaaataagggatatgtgaaagtagtaagagacagcaaggagttggggattgagtgatcaaatattgaggagagaagagataattgaaaccaaaatgtcccataggaaccaaagcaaggtgttgttaaggcataaataaaagaagattggacttcgaaaactagagagaaaacttttctttttttttttattattatactttaagttttagggtacatgtgcacagtgtgcaggttagttacatatgtatacatgtgccatgctggtgcgctgcacccactaactcgtcatctagcattaggtatatctcccaatgctatccctcctccctccccccaccgagaaaacttttcatttgatgtaagagaaaaagatgagaatgattgaaaaagtattttaagatggagaaatgggatttttttttttttttgagatgaagtttcactcttgttgtccaggctggagtgcaatggtgcattctcggctcattgcaacctctgcctcccgggttcaagtgattctcctgcctcagcctcccaagtagctgggattacaggcatgcaccaccatgcctggctaattttgtctatttagtagaaatggggtttcaccatgttggtcaaactgatctggaactcctgacctcaggtgatccacctgcctcagcctcacaaagtgctgggattacatgtgtgagccactgcgcccagccagagaaatgggatttttaagtttacccccaaaggggatagcctttaatcttctcataaagtagaagattgggtcattccctgaatggaagagagaaagggagatgggaacttaaatagggaaaagccttctaccatggaaacatacttggaaatcagtgagttgcagcagtgactcctcagttgaggttagcatggattttatagacaccagtagcatcttaatgttctaaagcaagagttggcaaacaatagcctgagggccacatccagctcatgtagcttataagctaagaatttttttaatattcttaattggttgtagaaaaataagcaaacaaagaaacaaaaaagggctgggcgcagtggctcacacctgtaatcccagcactctgggaggctgaggcaggtggatcacgaggtcaggagattgagaccatcctggctaacgtggtgaaaccccgtctctaccacaaaatacaaaaaattagctgggcgtagttgggcgtagtggcgggcgcctgtagtcccagctactcgggatgctgaggcaggagaatggcatgaacccgggaggcggagcttgcagtgagctgagatcgcgccactgcactccagcctgggtgacagagcaagactccgtctcaaaaaaaaaaaaacccaaacaaaaaagaatgtacgacagagaccttatgtggccttcaaagcgtgagatatttagtttctggcccttcctggaaaaagatagctaacccttgttctatagctcaggaccagagaaagcagatgatagtgtgactcagagatggggactgacattctggacatgatcaaagatcaaagggtgataaaagaaggtatactagttaggggtttttggtggaggtggacagttgggtgcaggttgagtagagagtaaagcaaagccagaagaaagctaatggattgcatgaaaatggaatatgggcttgtggatagatgtcataatgagaatgtaaagcctgatcagttggtttgaagcaaagataacaggtaaggaagttggaattggagaaaggggacatggttggttgtcttggagatacaagagtttcagaaattgccaactacagccattttaggaaatagctgaactctccagtgataaggtcaggatgatgaagcatccaagagtacgatggtcagattccttaagatgaagacaggaagactatgtatgcagaaataatgtgtgttaggttactggactttttcaaaaaagtggaagtgagcctggagtatgaagtagatgatggcaatgaggtaaaaagaggctggtgtaagtaggcaaactacttgtaaatgagggggaaagtgatgttggcagtgaagtggtcctctctttgccctggcagctcaggataggctgttccttccttttggtttggtaagtggtagaaggtagatgaaaaggccgtaggaaagatgtggtattatctattgcgggtcagatttacatgtacatagtctttgagtgtgggaggaacaaagcagcagattggtttggagttgtaaaatgaagccctcaaaataacagtagttgatttttgcatagatgtataaatgtttcacttacatagttcttcctgtaaagaatttttttaagcattagtgctttttactatgtaaaattcatttatttgtaataatgaaattatcaaggaattaatactaaacatatctctttttacttaaatgtgaacatggacaaaagtaacctggcaggtaacctttatttgaatattgaaactgtattgggctacaaggaaactagtagctacaaatcacttgggcctgatagtgatctttccatgacaacattaatgtaaagtctctattttagtatatgaaactttattagtagacatacatatagggacataatgtatatcaaccttaaatatataatttttatttgccaattatacctcattaaatctgaaaaaagtcaagagcaagggagcccctgccctctgaaacatgaagcaggagccctaggcaattgctttgctatgtttttctatgttgatgtgagagatgattcctgtatatgacataattggatagtgtattctgaaggaaagactcctttttgtgcttcccataaaaatatgggaagttcctaataggtaagttgctaggaatttttaccatgctaagttgaagttactgattcctctaataaaaaccgctttattttttctggagaattaaactattttcaaataatatgaaatcttaggatacctaaaacttcatttcagatggtacttttagttttaagtggttttcagtgaataacctttggaaatggttttaaaggtcgagtaaaacttattttgagtcatgaggagacaatgccttaattgtgtcatttactttaatattttttgtatttttttcctcagttcctattgtaaagaatatagcaaaaacagagtcttctccttccgaagcaagccagcattcaatgcagtctccacagaaaactactctaatattaccaacacagcaggtcaggagatcaagtcgaattaaaccacctggacctactgcagtccccaaaaggagcagttctgttaaaaatatcacaccaaggaaaaaaggtccaaactcaggaaaaaaggttagttgtatgtcctcctaatttgtattataggtttttatagtgccttattatttataacatacaatttaggaatttactaagagtatgatgagggtctttagaaatgtactaagagtatgtaggcttttgaaagcctcacataactatcgatagattgttatttctttgcttgggcaaacttaaaactttttatagtgttctacttcttcaaaaccacaatgaaagtactattaatacatgggtgtatttatgttcagactagttagtttgaaactcagtatactttaaaaatcaatgtgaagtgaatcttactgtacatatattatacctcaataaactggggcagggagagaagaatcaatctgatgaattcaataatgctggagtcaactctaaaacttagaaataatagaaaaagcaacaacctgaagacactgaagagtgaatggaagcagacagattctggtggcaggggaagtactcactgggataaggggtgttatacaaagtgagtttccattgttgtggttttaagccttaggtcaagtacactttgtgtaccatgtgaaacaacaggagtattagtagaaaaacaacaatttatctggcctagggaaaccagaaaatagaaaagccaggaaaactgtggctgttaaagggaatggagggattttggaagggaaaggaccagagaggttatctgcaaattctgtctaccaacgtctctgacagacccctgatctgagcatgtttgtctaatacacaacaggccggtgtagctaaagcaaaagatctgaactgaggctggatgaaattaggcccaagatcagaatttaaagttcaagtccagccaaggtaattactagctaaacaaaagaaataacaattatcagagaaatatagaatttagaatctgcacaaattaatatttgtaacatctggaatgtaattcacaattacccaaatacatagtaaaatgaataatattttcaagaaaaaagaaaatcaactgagacagacccaagtataacccagatattagaactagcaaacaaaaattttaaagtggctattcaactggtcttcgatgacattacacagacacacacacacacacacacacacacacacacacacacacacacacacaatcgtactgattaaaaagaccatcttagtggagaaacaaaggataaaaaggagccaaattgaaactcaagaactgaaaaatacaatatctgaagtaaaagattcactggacaaaattaaccagaattgactggagatgacaggagaaagagtaaatgaactggaagatagaagaatagaaattatccagtgtgaaaaactcagactaagattgagaaagaaaacgaacccagagaccttttagataatatcaaaggtccaatacaatgtaattggagtcccaaaaggaaaagaaagagaaactggagcagaaaaaatatttgaagaaataaagtctcaaaattttccaaatgtcatgaaagaaatgcatagacacaatactcagccaagagcaaacagaataagcacaaagacatctatctaagctgaggcatattagagtcaaactgttgaaaaccagagacagagcaaatcttaaagataacaatgtaagaatgaaaaagtacatgcagagaaacaaaaatttgattaacagctgacatttctcatcaaaagccatggaggccagaagagagtagaacaacatctttaaagggctgaaaggaaaaaaaaaaaaaaaactatcaacctgaaattctgtatctatcaaaaatactcttctagaatgaaggtgaacttagaatatatataatttttgtttgtcaattataccttaataaagtagaaaagattccttagtagaattcaatagttttcttcatataatttatactctcgtttattcttatttatttctgcatattttatgattcttgttgctattgtgaaggaaatcttttccttattactcttttctatgaaacaaaagatataaatatttcttaaaaagaatgaaggtgaggacattttcattttcagataaaagcatactaagataaatcattgtcgaaccagcactgcaggaaatgcttaaaggaaaatgagaccagatggaaacctggtttctcaaagagaaaggaattgttttgaagatggtaaatctttgggtaaatgcaaatgacttataataacatgactatttataactaattacaatacagtgttgcagagtttatatttaacagacatgaaacaattgtagtataaaggcctgacgtgggggatatggatcctatatcattgcaagatttcaccattttatgtgaagtggtacaatattaactttatgtggcttgtagaaagttaaggatgtacattctaatccccagggcatattgtaaaaaaaaaaaatgcaaagaattatagctaaaaagccaatagaaaattaaaatgtaattctaaggaatatttgaatattcaaatatattcattataaaatattctaaggaatataaactgttaacaaaaggaaaggaggggctgggtacagtggctcatgcctgtaatcccagcactttgggaggccaaggcagaaagatcacttgaacccaggagtttgagaccagcctgggcaacatggcaaaaccccatctctacacaaaatacacaaattagctgggtgcagtggcacacgcatgtagccccagctacatgggaagctgaggcagcagcagagttgcttgagcctaggaggtggaggttgcagtgagctgagatggtgcctttgcactccagcttgggtgacaggagtgaaaccttgtctcaaagggggaaaaaaaaaggaaaggaaaaggaggaacagaaccaaacacagaggagacaaatcaaaaacaggcaatgaaatagtagacccagccaggcgtggtggctcacgcctgtaatcccagcactttgggaggctgaggctggtgaatcacctgaggtcaggagttcaagaccagcctggccaacatggcgaaaccccatttctactaaaaatacaaaaattagtcaggcatgctcacaggtgcctgtaatcccagctactcaggaagctgaggcacgagaatcgcttgaacccaggaggtggaggttgcagtgagccgagatttcgccactgcactctagcctgggcaacagagtgagactccatctcaaaaaaaaaaaaaaaaaaaaaggtagacccagatccaaacatactggtaattgcatgaaaagttagtggattatcctttctagttaaaaagacagagattatcaacatggatttttttttaaagacccaaatatgtcctgtctacaagagatgcactctaaatataaagacatagaatcttttcagatctcttgtggctgactgaattaaatgccagcagtattatcttacacattcctgagttcagccatccgatatcagtatctataacatttccattttgtttcaacttatgtttgctgtatggaaaaaaaataacattgtgattttaaaatatattgatactgttatttttctttaaaaacactcaaaatttacaaaataaaaatcaaaagtcaaagctaaatatttcaaaaatatagtcatgaacattgaaaaaaatcaggcagattgttctaatataaatggtagcagatgaaattttttaaatgaaaaataaaagtaagaaaagttaatagtgaaatttaaagtgaaataatattttaaatgcattaaaaaattaacatgtgtgtatattttccagcttctgaaatgtctttgtgattagttggtataatggtgaaaatgtaagataacaccaaatagtttcctttgactcctttagtttccagttccaagctaatttgataattttggagagctctctttgaaaacattgtttatttgatgatggggatggagaaggggcaggtactttaatcttttaaaaattattttaaaagttttttactttttattatgaatacataatacttgtatgtatttatgggatctatgtcatatttggatacaagttgtcattttcttcctccccttaagggaggagtgcaggagcacattttcttaatgaatgtacctttattcaatttgcagtgttaatgcaaacatactatcttggtatgtctcaagacaaaggattcagatttcagatttttaaaatagtgaaagaatgacatggtcaacccagtaattataattcagtactgaaaaataacatgattgtgtccaggcagtggcgcatgcctataatcccagcactttgggaggcggaggtaggaggatcccttgagcccaggagctcaaatccagccagggcaacatagcaagacaaaaaaaaaaaaatcacattttttgtttctttaacattgataaagaacactgtatcaatgttaaataaacaaaaaatgtggtttactagattactgtcaacccaaacgacagccattaatttaagcaaataaatttcagcaacatcgaatgttctattttttactcctttgttcctgccttttaaatgccctctgttattaccttttctatgcacaggagtcccttctcttatattggagagtcatgtttgaaggtagctcctggaaaaccccaagagttgatgtaaaataaacaaaatgctagtgaagtttaacaatgctcaggaaacattggttcttataggcagtaggcataattttgtatagactttagcaagccatctgttgtgattttgtcagaattattgtatgtaatatggagaactgtgggttagacacagcgaagactaactagatgagcaacttctttctgaaaataaactctgtcctctgccttgctgagattttttttctattggaggtattgctctgggttagagatttacagacttttctttagcaatgtgaaaaaacttgtcttacagggaacctcaaaaaataaagtatgttttatggaataatctaatttggctaaggtgtgattagttggagcaggggtaggacagggaatcccagccatttggtctctttctcccctacctggacagtttgtggtcctctgagaagctcagtttggaaagttctgcagttcatgacacacacgggagtttccaacctgaggacttctgataactaataattttataaaccaatgatatttataatttctgactttcttatctaagaatatattaatgagtattgtatacttgtgtttttttccctttgtttttaacaggaaaaacctttgcccgtgatatgttctacatctgcagcttctctaaaatcgctgaccagagaccgtggcatgttatataaagatgtcgcttctgggccatgtaaaatagtgatgtctacaggtaaattcatattttaaaaatagtatagaattactaatcttttatcctgtattattttcagtgtcttcgaagtcctggaaataaaataataagggaaaaagatggtaatattaaacatttatctttgcatttttcatattaaagtattttgaaattctgattgttccattttacattaaggaaaaagtctttaaatacatgagtcacttgaaaattcagatactcttaaagtattttatccatttaagtaagatttatgcaatttacattgtccaatctattcttgttttccctttatctcatttcaaaatttgtctttttgtatggtatgtattttcaaagctgcctcaaaccttttcttaatgccttttaaaaattatctcccttacactctcctattccctggacttttttttccttttaatttttctttcctgactaaaagtaaatttagttttttaaaaatagaagtcactttaaaaatgattgttgtaacatatctcatttttttcagtttattatttctgatttttaattagcaggaaagactagctaaatggatataacacaaaggagataaaacattgaaatccttgtttagcttcgcttgtgttcagtagaatttgtccatgtcatcagcaccgtgggttgaatttttaatagctatttcatttctgaaggataacagtccttcctctggctgttgccacaaaattgaattgtatatttcaacagagcaaaactgagattgatcagttttcttatactaaatatagactatgtgtgtgtgaaagttttgcaatattaattaatggattaaaaataacatgcttcttagggggacaatttattttatttttggtagtgatgtgccctcatgttttgtttctttgttgttttttttttttttgagacagtctcacttcatcacccaggctggagtgcagtggcgtgatcttggctaaatgcaacctctgcctcccgggttcaagtgattcttctgcctcgcctcccaagtatctgggactacaggcatgtgccaccacacccagataatttttgtatttttagtagagatggggtttcactatgttggccaggctggtctcaaactcttgacctgagttgatccgcccaccttggcctcccaaagtgctgggattacaggcgtgaccaactgcgcccagcttccctcatgtttttatagtgtatattgatttgcatttgttgattctcagtaaagaaaattattggaagttggcatttatgtgattatagatgaattgcttctatatcatatgcttttattatactaaggaaagagtttattttaaaattttcttccatgaatcttggtatatatagaaggaacatttttattttcctaaaattaataaaatattaatatatatcaatataacttgttatatatatcttaaattgtttggttactttagaaaatataattgaggtgcagtattggtgatttaaaataaattcagtccaaaaaagagcatagcaagatgacccgttttgaaaggaaattcttgtactgtgtatacaattaaaagatgaaaatattcatctgtctttgtgccattttatataatgtgggaatgtatgaagaattgtttttgtgatgtgcctaaaatgtctgtagattttatatcatcagtttggacaagattctaaaaaattgaataaacattttgattgtttctttgtgggttcagtgtctttgcatcaatgtaaaaatatatttacatatttttaggtagcagaaatgatcattgatattaactatatttaggttttctgtgagtgaagtggatagtgggatatagtaattgattatgtagtgttttcacaaaatttcttttaatcagtctcattgttatgtatgcatacgcattttttctcaagtctgtgtctatgtaaacaaacatggaaactttggccctcatctggatcccaagagaatccagcagctgcctgaccacttcggcccgggcccggtgaatgtggtgcttcgccggattgtgcaggcctgtgtggattgtgcccttgaaactaaaactgtttttggatacctgaagccagataatcgtggaggagaagtgataactggtatacttatctaatacattgtctaattcagtcccttcccccttcccttcccccttcccttcccccttcccttcccccttccctttcctctccccttcccctttcccctccccttccccctcccccgccctttcttctttcttccttcatctttttagaacagggtctcactctgtcacccaggctggagtgcagtggtgtgatcttggctcactgcagcctccacctcccaggttcaagcgattctcccaccttagcctcctgagtagctgggattataggcatgcgccatcatgcctggctaacttttgtatttttagtagagacagggttttgccatgttgcccaggctagtcgtgaactcctggcctcatgtgatctgcccaccttggcctcgcagaatgctgggattacaggtgtgagccaccgcacctagcctgtaatatttattatattagtataatagaacatttataggagttatatgtttatagactttaagccctggtttgaaaagtttacttttaaaatggacaaatgatgtcagaataatgtaaattgggacaaaagtcacagattcttcgttttacatgctgtgttaagctcactataggcagagtaccttggctgataatatattttatctataagaagctctaaataaatatgtgactcaagaagtcactaagcaataagatagtgttggtggctatgatcagacaccacaacattcatacccatggaatatttggaatagaaggaagtgttacatagatcagtgagtttctgttgttgttgttgacttaagagtattttcaaatgaggatgtttttaccaatacaggctattgtgtttgagaggagcttttataatataagatcattcctttatgaattacaaagaacacaaattagacttataatacctttcctaaggtgatagttttttttttaattagtgttgtatttctcatctctctgaggttactgacatccttttttttcccccaatagcctcctttgatggggaaactcattccatccagctccctccagtgaacagtgcatcatttgctcttcgctttcttgagaacttctgccacagtctgcagtgtgataaccttttgagtagccagccttttagttcttccaggggtcatactcacagctctgcagagcatgataaaaatcagtcaggtgagagaaaatgtaaactcttacacttctgtttcacttgagaatcttgtgtaattgtttttccttgtgttctcctcaaagtaaacattttagccacagtgaactaattagaaatgtataacatatagttgtttttgttcattcaaaataggaaagtaatttcttgtattcataatgaacttcagaatcaaagcccatggcttacttatgtttggcttcattttgactacctcacagagttaaacattctctattagactgaagtatggctttaaagttactgacttttataatcctcagaagttagcaaagcgtgttgagcctattggctataaagataattttgttgtcattgaggtttgacaaatgatgatacggttttgttgttgtttttggagacagagtctcactctgtcaccccaggctgaagtgtagtggcacaatctcggctcactgcaacctccgcctcccagattcaatcgatcttcctgtctcagcctcccgagtagctgggattacaggcgcccaccaccatgcccagctaatttttgtatttttagtagagacagggttttgccatgttggccagggtggtcttgaactcctgaccttaagtgatcctcccgccttggcctcccaaagtgctgggatttacaggtgtgagcctccacacccagcctgtgatatgcttgaatttgacatttgaaccatggttgcttctcttccataagaaccccaaaccgatgcctgaataaaagggtaggtgtaagatagccctgtagaaccaaaagtgggtttcttgcttctgatccctaaagcaagaaagctctttcagcttttatgcaagtgctgtttgttttttgggagtggtttgtctctttttcatgtgactcatgaaagctaactgtgttctattgatcatggcaggattgtatgtgggtcttttaagagtagctgaagttctcaggtgttattgccgcatggttttctggccagctgctgctgattctggaaatacagagtaccatcacagactatctttttaagtccagggattctaattcacgtgccactcaagtgtgaagcgtgggtaccacgtctctagctactacttttttttctggtcctcctggttaccctcacccttcttcataaagcttgtctcctctacttcagtgacatctctcatatccatccccttttttccatttccttgttactaccctgcttcagactgtactaaccccttctctggtttagtaaagcaggcttctaactggagtcctctttccagtttctcccctctggtgtagctgtccagtgagtccctttgaaataaaggtatgatactgtgacatgcttgcaaaaagtatacatggagaagcagtggcatggagagcacaggtgttggagtttgtcagacctgggttccaatcctggccttgtaatctctgctgaaagagtataaagtctgaccggcctacattttaattcagttcctgctgttaactagctatgtgcccatagacaaagtactgagcctctctagttctcagtttccttatctgcaaagtggatacctctttggttgtgaaattgaaagaaagtatatgtaaattcttagcctgcattatgcctggcatgaagtaggagcaataaaaggtagctgttagaactagggggaagaggaagagtgaggtttcatgttttcatgtgatattatcctttttttttccttcttcaggagaggtaggaggtcatccaaaatggtaggaaatttggaagatggctaggaagggaagggccacctgtgtgggaagaggggtgtctgtgtattgataggttttctgtttctaagagtaatttggggaaaaatacgagttggagatgttgagagtacaatttcctgatttctttttttttggacacagagtctcagtctgtcacccaggttggagtgtagtgacaccatctcggctcgctgcaacctccgcctcctgggttcaagtgattctcttgtgtcagcctcccgaatagctgggattgcaggtacctgccaccacgcctggctaatttttgtatttttagtagaggtggagtttcaccttgttgaccaggctggtctcaaactcctggcctcaagtgatccttccaccttggcctcccaaagtgctgggattacaggcctgagccaccatgccaggcccaatttcctgatttcttacacaaagcattaagaatgccagtaatttacaaagcctcattctttgaaagattttaaagaaaatgtaattcttctttaaattgaacacaaaatgtttgaattttcagattaatcaaataatcagaataggtaactatttgaaaaaatacactgaataatccacatattttacattattttaggggttattaattttctgtcacagaaagcttaatttagccatttgaaaatggctttgagttggaactcttatgtttttcttaagtcagcttgtagttaaagaagttgcatataaatgctatgaggttattactaagatttcacgtctagtatcccatttctcttacattttttaaaataagtgactcaaaaatagtttaagatagagtgctcttcttaggagactttgattctgacaaatctagtgtttgcatattttagcagtaattttgaagacattttactgaagtatagtatacatagagaaaattatacatggaatgtagcttgattaattttcatgcctgtataatcagtcactggttggaaaagtagctattactagtaccctagaagcactgctaatgtgtcaaaccccctttaatccactactacccctcacttcgcacaaggatacctactgtcctgacttctagtaccatatattacttttgcctatttttgaactttatagaaatggaattatacagcatttactcttgtgcctagcttttttggcctatcattatgtttgtaagtttcatctgtattgttgcatatagttagatcattcattctcattgctgtataatattctgttgtataaatatgctaccatggtatgtatccatttgagtgctttctgttttgtgcccttataaatagtgttatgttttgtactcttataaatagtgttatcatgaacattctatacacgtctttctgttcctgtatctatcttggagggaattgctaggtcacaggaaatgcatagattaagctttagtagatactgccaaacagtttttcaaagtggttgcctcagtttactttcctatcagctctctgcttttttaaatagattataattcttaggtgaaattttttattctttgatcttttctgtccatttttcctgttttcttgaacatattcatcaaaattgcgttatagtctttgtctactgacaccagtagtttttctctcaatagttggttatatggtcttacttctttgcatgtttaccactatttttttgtatatgggacattgtatataaaagatctgcagaagctccagatttctaccttaaaaagtttcctcttttttaagcagaaagaaggagggctcattccattcagtgattgagctgggttgggactgaatagcagttttagtaagactcagtctatctcctgattcctcgctattcttcaggtgttactttcccaggattttgattgagaacctgggaattccctagctccttagccttgaaagactggggaattgtacttcccttcttcaggggtttgctgctcagctctttagccttcttcctcatgtattatcacaactttgcacctgtgtttaggtggcttgtgtgtttgccacaaacacacaataaaataaagaccccctggtgggtctttatttcttaagcatcatgagactgtgagagatttcagcgtgccttttaagagttttcagcctaactccccagcttcctgtatagctccagaacttggcaaatatcccatgggggaaaaccagctgagtttgagtttctgatttgtcactccagctgtgtgaagctgctaaatcttttttgatttatttttgcctaggtatggccctctgcctgtgtcaagttctattttcactgtagtgccaagaatcagcagattcctacagggaaaaaatatgacgaaatcttcagtttagactagaatggttcttcccttctggaattggattttattagttcctatgactgctatactttgaggatgcttttcttatagtaactttattgagatataattcacataccataatttcacccttttagaagtatacaattcagtattttttaagtgtattcacagagttgtgcagtcatcaccactgtcttcatcacccccaatagaaatcccatacctattaactatcatccctcaatgtcttttccccctcaccactggataccatttattgactttcttctgtctttatagattttcctattctagacatttcatattaatagaatcatataatatgcaacctttgtgtgtggcttctttcacttagcataatgtgttttgttgtttgtttgttttgtttttttgagacggagtctcgctctgttgcctaggctggagtgcagtggtgtgatcttggctcgccacaacctctgcctcctgggttcaagctattctcctgcctcagcctcctgagtagctgggactacaggtgcacaccaccatacacagctaatttttgtatttttagtagagacgtggtttcactatgtcatccaggctggtctcgaattcctgacctcaagtgatctgcccatcttggcctcccaaaatgctgggattacaggtgtgagccactgtgcccaccctatgttttcaaggttcacccatgtggtagcatgtatcagtgcttcattcctttttatggctgaataatattctattgtatggctatattatgtttatccatttatcaattgatgtacttctggattgtttccactttttggctattaggaatgctgctgcaatgaacatttgtatataagtttttgtgtggatacgtgttctctcaggtacaaacctaggagtggaattgttgggtcatatggttaactctgtttaacttgatgaggacctgacagacttttccaaagaggttataccattttacattttcatcagcagtgaatgaaagtttcaatttttccttttaaacacttgttattgtccatctttttcattatacccattctagcaggtgcgaaatggtatctcattatggtgtgatttgcatttttccagtagttgatgatgagcatcttttcttatgctttttggccatttgtatatcttcagagaaatgtctgttcgaatcctttgtccatttttaattggtttcattgtctttttattgttgagtcataagagttcttcgtatattctggatacaagtcctatatgaggtatatgctttgcatgtattttatcccattctttggggttgtcttttcacttcctacttttttttttttttttttttttttttttgcaatggaatcttgctctgttacccaggctggagtgcagtggtgtgattttggctcaccgcaacctctgccaccagtttccagcagtcctcccacctcagcctccagagtgccaggactacaggtgtgtgcccccacacttggctaatttttgtatttttagtagagatgaggtggcatggtttggctgtgtccccacccaaatctcatcttgaattatagttcccataatccccacaggtcatgggagggacccagtaggaggtaattgaatcatgggggcagttaccctcatgctgttcttgtgatagtgagtgagttctcatgagatctgatggttttataaggggcttcccccctttgctctgcacttccgcctgctgccatgtaagacgtgcctttgctcctcctttgccttctgccatgattgtgagtcctccccagccatgtggaactgtgagtctattaagcctctttttctttataaattacccagtctccagtatgtctttattagcagtctgagaacagactaatacaccagccttttttttagttctttagacatgattttcattttttaggtccttgaaaatatttataatagttgatttaaagtatttgtctaggtcgggtacagtggctcacacctgtaatcccagcactttgggaggccgaggtgggtggatcacaaggccaggagatcgagaccatcctggctaacacagtgaaaccccgtctctactaaaaatacaaaaaaaaattgccaggtgtggtggcgggtgcctgtagtcccagctactcgggaggctgaggcaggagaatggcatgaacccgggaggcagagcttgcagtgagccgagatcgcaccactgcactccagcctgggtgacagagcgagcctccatctcaaaaaaaagaaaaaaaaaaattagccaggcgtggtggcatgtgcctataatcccagctacttgggaggctgaggcacaagaatcatttgaacctgggaggcagaggttgcagtgagctgagatcatgccattgcactccagcatgggcaacagagtgagactgtgtcccaaaataaagtatttgtctagtaagtccagtgtctgggcttccttagggacagtttctgtttactgatttttttttcctttgtatggaccatactgtttctttgcatgtctcattttttttttgttgaaaactggacatttaaaaatcatataatggcaactctggaaatcagattcccttctccctagggtttgttgttgttgctggtgctgtttagtgacttttcctcgactaattctgtaaagtctgtgtttctttgttaagagtggccactgaagtctgcttggttagcttaatgtggttagctaatgattgggtagatatttccttaaatgcctggaaccagtgtatctcccagccttggccaagggattttctgtgtgtgttgggacataacttcagtgctccaagaggcagcttgtaagtcaaccttgtgcagagcctcaaggtcagccagagatgaaagattagggtgttctcatgtctttcctggacatgcatgtatacatctgtgcatatgcatgtgaaccgtctagattcccaggaatatgtttgtgtttttcaaagtctcctaggggacatcttatacccagtttttccttttaagctttttggccagcctgttgttagccctgactggtaatattgtctcaggcagctgcaaagttaaacagttgccaccattttcccccgtcagatgccctggagatggggttgttcacacagaacaagctctaatttaggtcaaaaaaagacaaaccctgaaaaggagcttttcagtgagcttcgagactggtctaatagtgatagttctctgggcatggggcttttggagagctccaaacccattgtgccccctccagcgattatcgcatggctgtttttcacacctgctgtagttgtgaagtgttggttttcaaggctactgtgaaaatggggtgagggggattatattagggcaagttaaaatgccacagaatttgctgtttttttctgagatccatccatttttcttaaacactttggattgttgcaagtctttaatttccagagttttgaaaaagatagtttttatagtttttgccagtgttttcattgtttttatgaaggagtagatttttggaggtctttgatcagtcatcctggaagtgcttctctgatgatttaaaaaatactttgtaaattacctggcttttcctagttatctctgtaggaacactttgctcccttagcttactacaatacgcagaagcagaagtcgagtcaattttatatttgtttcagccccagatagtagaccatacccagcttgataaacttttcataaagcatgagtacattacaaataaatgatgaagactttttctaatcttgccgagattctgaggtaaataaacatttatagaaaactatattttagaactcgaatattccatattattaaatgggtatgaaaagccagttatttctttccttagaatttaatgtcttaattgtagaaatatgagatatgttttgcctgttggttttacagtccattattaaaaatgaaactaaagtggtaagagctctactggactcattgggattcactgagtaactagattgagctaaaggttgctcatcataagattttgagaagcatgcctggccctcagccaaaattttgaaccagatgaagtttgactttgatactcattgcaatctttcttctcttttgaggtctactatcagactttttagatttctcttacaccttatttgtccttttagttggaggttaaatcaggatatttgttgatacttagggtataactgataattaaagctgtctttactttcaggatcatgctttacggagtggtcctttaggtagaagtgcatttggttgaatgataagtaagcagtagacttgttttaagggtagctctaggccaggattgttacttaacaaaatggatgttcattatattatatcatttaatttctctgaagttttaactcctctggctcatgggaacaattttctcaggccattttagacacattttaatgggttgcctcactgtcttgtgagatatttagagagatctgataacctcagaataaagaagcctagatatgctccttctggaaatgcttttaactcttgaatattatttcagtgaaaatataaaataggatgaaatagacacatgttattcatgaacatcaaataattgagaagttctcaatgaaggtattgtaggcaaatgatgtagaaacagaagtgtttcatgctgatgatatgaaaatgcttgagtatattagttcgttataacagacaactgttttttctttgaaaacagcaaaagaagatgtaacagaaaggcaaagcaccaaacgatctcctcagcaaactgtaccatatgttgttcctctctctcctaagctccccaaaacaaaggagtatgcgtctgaaggtaaatagcatttacacctcccaggactgggaagaaatgtttctctgctaccacttatgtatactcttggggtggtagtattggaggtagggaggtaaatttgcccaaacaagtttggcagttaggctactacttggacagctttgttgaacccttcattcccttcagaagtggacggctgtcatttctccatagattaaaaaaaaattgtaataacctttttccttcacttttgtattgctaaaaactggcagaaagaagaatagaaaaacctactgcctttctccagagaatgtaactgcccaagtagtaaacaaatgttagaaaccaactgtatgatcatattataacaaatagtaatgaagaactgcatttctaaaaacaaatgcttcagtgaggtgtttatagccttggtggcaagactggcaaatgatagtaagttactatgaaaaatataggtgatatggaatcactttggactgtaggacaatgtccattaatataaatgccaaggaacgccaagtcgggtggatcatctgaggtcaggagttcgagaccagcctggccaacatgatgaaaccctgtctctactaaaaaaaacccaaaagattagccaggcatggtggcaggcgcctgtactcccagctactcgggaggctgaggtaggagaattgcttgaacccaggaggcggaggttgcagtgaaccaagattgcaccactgcaccccagcctgggcaacaagagcaaaactttgtctcaatcaatcagtgtatgcatccataccaaggaggggatagccatgaactttgtgttagagcattgtggttcagtatagcacaagttaagtgaactattgctagggatgagatttttaaccttttagtagtatttgaattgtaagtctattgaagatagcctcctttgtctttttccctgtaggagaaccattgtttgctgggggaagtgccattcccaaagaggagaatctttcagaagattctaagagctcatcactaaattcaggaaattatttgaatcctgcctgtagaaatcctatgtatattcatacttcagtctcccaggatttttctcgaagtgtgccaggcaccacaagttcaccactagttggggacatatcccccaagagcagtccccatgaagttaaattccaaatgcagaggaaaagtgaaggtatgttcaaaaatagtgactctcaatgtgtttgtcttttgccttgagattttcatacctaacagcatcccctgagagtatcacattggagaaagtgctaaaatttgggaggctgagtcctctctttcacatcactgtcaggtcagaccattatggatcctccaatcctcttgacagcacagaactgtctctagggatctggatcaccaaccatgtctctgatagagacttctcagattagtagtgcttgaacagttgtaatttatcatttccttgggtaccgtctggactcacaaacctctcatgactctgaggcctggaaagacagtccctctcctttctgttgtacacttttcttcgtctctcttgagacattcctggcctcagcctgtgttgactcctggattcgggctggcatcttgttaccacagccacaccatttcctcactctccacatccttcctcagacccaccaggaagtcatgacatgtataagtagggcaatatcctgttgccatttagaaagagccagaacaggccaggcgcggggtggctcacacctgtaatcctagcactttgggaggccgaggcaggcagatcacccgaagtcgggagtttgagaccagcctgaccaacgtggagaaaccctgtctctactaaaaatacaaaattagctgagcatggtgatgcatgcctgtaatcccagctacttgggagcccgaggcaggagaatcacttgaacccgggaggcagaggttgcagtgagccgagattgcgccattgcattccagcctaggcaacaggagtgaaactccatctcaaaaagaaagaagaaagaaagaaaggagccaaaacggccttccatgtgcaaagagggctaataccctgtacctttgaaggattaagggtacaggagagtgagggtgggaataagtgttttgtcctttttctccaggtaggcatgcaggcgaggttgaggagtgaaggaagtgggaacccttgcctttgatcatgggtgttatctatgggcaaccacactgtgcacacaccatgacacatttaatgttgtcagccccatcccctctggagattgtctctgcctttagagtgacatagcttgcagagtctaacaatagatgcttactccataatggctagtataccttgcattttaaagtattttcacaaagtatgaccttttggcgataggctttctcagtataaggttacttctaatggtgaatatctcactttgaaatgtatgtcaaacactaaggtagccggtattggggcatcagacggctagcttctggtcttcttagcaatgtagagactaatagtaataacattgctttctagtaatttacttactggtaatagaaataatcatcatcttcatcactatctgatgtatgccagggatataatatttcatatggcctcctacattatattgttacaacaattccttgaaatgtaggtgctggtaagcattttcaggtaagaaatttgaagtcatttggctaaggttcctcagctagaaagtggctgggccagtccttgagctcaaacactctgactccagggttgtactcttaacttctgtactccttgcacctcccaagaatagatacgcatttccattagaaactgtctagaggtgtcattactattatttttaaggcatttgaactgttacctagagctaattccactcctgacagccagtgatgctcacacaatttcctgtcctgccttgtcccattatttgaatgaaaaatattgctgatctttattataggaaagaaatccaatgatgtcgagggggggggatcagatcactttcatactttcattatatttattctagaaatatttattgatatgccagtgtatataagacagagccgttcaggagaaaagcatgactggactttgattatttttcacatgattagtttgtttcatgtaattatttgaataacaataatgtaatgcttgcaaacttctctgattgttttgaagatgtaggcccaattaaattatattttcataatagactaaaaatagaaaatcttatggttttatttttaatataaaattttataccccaaatcatatctttttacatatagtttatttgcagtaaactgtaaaactagttacatgttattcaaaacataaatgtaccagattatgatgacagaaaccagaaattccacaaaaatgtacattaaattagagatatgattagctttgccaatgatttttttcatgttatgttgtgtctttgttaagttaaaggagatggtgtttctgtctaaattgtcagaatgctaacttaggcacagcatggtctacaccatcatcatttttacttgggttgatacagcctagcagaatttctctgtagatatgaccaacatttttttctctgagtggaggggagaatatattttggtatagagtttttatttcacatcatcgttgtgatgttggaaagaaataaaattcagagctacacacaaaaaattaaccactataagttcttttattttctgtttttctttatccttcccctaggtaaatatacttaaaatgcttctaaaatggccatagtccagaggataggaaagaaagggtactcctttggctaattcacacacaaaaaaacatcaaatttgtgttgacagtccttggttagcaaaacaaatcttcctagctaagtacaaaattcacttcagttatccacactaactttagggagttaagggctctggttgagtaaatgaatacttgtcaggacacagattttatcacaacttagtaaagagcacagctaagaccatttgaggtatgagcacttaaattgtttcatgtctcagttatgtatttttttaatgtataaaccttcaaccaaaatatctattactatgcaattaaacatgataaaggagttaaattaaatgttaaagttatttctgacctagcttagcagaaaataatcttgtcttcttcaaaattcagataagcatttaagccatgagagacaggaatctaaagagtaaagtgatgctaaaaatattcttattggatacatcagagagatttggtaaaaggactaatttgtttatcaaaaataatgggattattgaaattctttgattaaagtgaacacatttaagcaattagaaaactaaatttagccaggtatggtggctcatgcctgtaattccagcactttgggggcctgaggtgggcagattgcttgagtccaggagtttgagaccagcctgggcaacatggataaatcctgtctctacaaaaaatataaagattagctgcaagtggtggcatgtgtcagtagtcccagctacttgggaggcaaggtgggaggatcacttgagcctgggaggtcagcgctgcagtgagccatgattgtgccactgcactccagcctgggtaacagagcgagaccctgtctcaaaaaaaccaaaacaacaacaacaacaacaaaacaaaacaaaaactaactgtaaatttggggaatttccatcggatttagctagtaaaatatacctagtctagacagatagagagagattgaaattccttgaaagacttaaagtaagagagaagtcataggttagattagattaacctaattttacccgagtaacagatcttttgctgtatttgtctgtggccaaagaggcttggattgcttagtctgttttgtgatctttgaagctttaaggtaacgtctgaacctgcttttgttgtttgggggaggtcagatgggatgctcttatgtagccatcctcacatcatttttgtataagctttcacagttggagtcttgagaccttgttggggaacttaacaaaaggttccaggaatgagaccattattccctacctaacatctcttctttcaggataatgatcaggtcaagtatgatttgtcttttttcccccccattgaagctccaagttatatagctgtacctgatcccagtgtcctgaaacaaggcttctctaaggacccttcaacctggtctgtggatgaagtgatacagtttatgaaacatacagatcctcagatatcaggccccctcgccgacctcttcaggcaacatgtaatgtatcttttgatccggttttcctgccgtaatgcctttgaatgacctctgtgcaggcccttcatttggatgctgtgtggatggtgggggaaccctatcaactgatttttccatatgtgagagaggttatttttcccaagattagttccttaaatggtagattaatggtctgttctttaagtgagtatccaggtgcctaaaatacaaactgcttcaacttctcaagatacgatgattcagcattgcaactctcaggtgtaccttccctttgtgatgacagatacaaggatcctccccgacctgctcccagctcagtgccagaaccatgagtaggaggggttgaccacaagctattacagggtggccttcctccagtgaatccagcaactttataagattaagtacatccttttaaacaggaactcacaaataccaaataatatgcttccatgacataaattgattaaggtaataaagaattttaggaggatgccttgtgactattaagtaatattttcagtgttttctaacaaatcaaatgagtgatctattatctgaggtacccttttcactatcgcaagaaaatcagtagttttagcatctaaccagcttcagacaactaactgattagccttcaacataatgacaacactgtatagcacatttacagtttgcattgatattgacatattcctggcccttctcagaaagttattgatcatctgaaattcatttctaccattcataatttttgatcttttgtcatagatatatttagtattttatttaacacacagtatttaaagtcagattgtttgatacttgggacattttttgaagatacaagattaaattttcttaaagtttgaactaaattcataaattatcaaatgatgcttcactgtataaattatatttttaatagttttcaggaaataaagcatattcagagaatatatatccggagtatacagctgctgtattttacatgttcttatgtataaataatttgatatgaaagcattattaatgattatgatttccttctctctgtaggaaattgatgggaaggctctgttcctactcaagagtgatgtgatgatgaagtatatggggctgaagctggggccagcattaaagctgtgttactacattgaaaagcttaaa

SEQ ID NO: 5528 - DNA, 268444 bp, human
tcatttccgccgggcagctagtcgtgctcggggcttcactcccgcgcgtgaggcgagcgggcaagttggctgagggcgtgcggcagaggctgcttccctcggcgacgcgacccctcagcaactcaagctatgaactgaagctccctagggacggagaccggagcggagcggcggaggcagcagcagcagcagcagcagcagcagcagcagcagccgccgccgccgccgccttagcgggaactgagcagacccggcgcggagccacgactcctgcacgtttacctccctgtcgccgttcctgccggcggttggctaaaagacgttacagccgcgagacccgacacacaaaagccgctttctccgcgccgcccgcccagggaggctgcggccagcaagggaccccacctgagagcagctcgggctgctgagttcgttttgtgtctgagctctgcgctctgcacggaaccgaccccgtacccatggctctgataatggaaccggtgagcaaatggtctccgagtcaagtagtggactggatgaaaggtaatgcccgctgcggggagggtgaggcggcactggggcgcggggcaccagtgcgaggttaggagggggcgcccgccgcgccagagcccgccaccgcggcttccactggcggatcgtcgtacgcgtcggggcgggggtcctccaggactggcaggggcctggggtccccggtctccttttgtctccagctagaggggcgcggagcggccagagagctagagggcagcgggcgccaccccgttggaggcaggaagtcgggaggcagaataccggcgcatcttgcgtactcccctctccccttactgcccccgggccaggaggacgtggcgacccttatctcccagctcagggtggactcccccaggacctgctcccctggtcgccctttcctggcccctttgttcctgggaaagctgacgccccctcggcggccgcccttgccaggtgccttccccagcgccaactctcccaagcaacttttagcccacataatggggtcaggacgcggccgcccccattcggagcctggcatccccccacacccagatttggctgaggatgcccagggtgggggtatgtgctactttgagggtgaggacatcatgcttcccctgggacagcatccttgctgctgtctctgggctgcctccagcgcatcccctcgcatcctttgccttctctgctttctccctttcaagccagtcgaggttttggacctcacggctttttattaagggctcaacgccagatgtaaggtgatgcgcattcaggtaccttcacatttcttccatcttgaaggttcccccttttgtccctggcgatttataataaccacagttatagacactcaccctcctaatcgcaaacgtgagctttttttctgatccctgggctttcctgtctcactacctccctctgttgtctgagttaaggggcttgtagaggactcccccacccaccaaccccttggatcctcaggcccaactcttccctaagattttgggaattgaagaggggatggatgggatggaatggaataaaggatgcgtggccacacttgggaaatgttagcgctttgctcgaggtcatacctgagcaaactctaggtagatcagtcagggaccaaaggcttattatcgctgaaaatgcccgttcctacgatgaaggagccccttcttgggcttacttaacagtcagactttctaagctccagataatttagaacgaaaggtgaggtgattgggagggattgagagtgacagggagaaactgattttttttgctcattcttttccccagcctttttggccgcttgcttattcttgtggatttttctttattttgctttccttttattcccttacttgcccctttattcctcatttactttgcttttcttttctaatatgtggaaactgctttgtaactgctaagcagtacaaatgtgagtgaattgaattaaacctaatacattatttatcgactgcacccctgtgtgcagtgcattgtgctaaggtgccatgggggatataaagatgactaagacaaagtcctgcagtggctcatctttgctgctgctttttctctttatgtatttgctattgaaattccaatatcttagattcccaccaattatcctcactctccaccttctccgtttctcagtgatggaagaaagagccagagtatatacaggaagcaacaatgcttaaaaccccgttctttgaatttgtctaaaaggttactttagtttgagtctgttgctgaaatattaaaagacaagctatcttggctccatgggagtctgattaccttcatagactacctttcgcaaattcccatgatgcctgtagtgagtgctgcatactcagtctccacctcccaccctcccagttatattcttgcagtttcccctctctccatagtttaggtccactgaagcaagtagaatatatgatgcacctattctgacacacattattagttgtccagtacaccagtcctttaaaaatctttccagcctaaaatgtggcttctttgaagttaggttaacattgttagctgtgatttgaaaattttttttaaatgtaagtcgaataccttgttttcatacctgttggtgacgcattttagagctatttgaaaagatcaattgggtagccaagatagtttgtgtatcgtgtatacatatgactggaagagaatgaatgatataattacctgtatatttcaaatcccagactacttactgctgaaatttccttaatattcatatatatttgatttgagatattatcagaaaatgagattttaaaaaatagttggatgaaacaaacatttcctcaacttgtaacttacactgttaccttaatttttctctctttgcccttttccccaaataaagttaaacaaaggacattttaaaaatatttttcatcctgcagtaatatttaaaagtcaactgctaatttaggctatagctttgagatggctaaacctcatttagtgttgtataatatgtagtgttgtaaaggcagtaccaaagaatgaacaagactgttgaacaactgcaatgtgggagttcttcagaggatgctcctaatgagacagtttcatcatccttagcattaaaagcatatagtatatgctttcagctggtcacaatcataaatagttgtaactctgtttagtaaggtacattctttatgtactttctagggtatttttttcttcactaaacagaaaaagaatcgctaagtgtgtaagaataggaatggccatatatttatgattctagacaatttgtagaagtggtatagaaactcagtcccagagagggaaatgaagggggaaaaaaagctgacaagattattaagctttagtggcatatattcaagattatttatgagggacaatttttacattgcaattttgatgcaatgtataaatggattcattttgattgatcaatttttattaaaatatttgagggagatggaaatataaaatgtatatattgttagtagtaaaaatataaggaaatccttgtattcttttgctcaccaacttcattatttgtaaaatcaaatactcaactaaattttctactgacagtaaaaattggatatgacacagtgtcaatgttatttccagtaagtacatgaactccttatgagtcagtgaaataagtagctatatcccaaattatcctgatagtacttctggctatttggagatatcttatagaccttcaaattaatttttaatattaatcttataaaaatatttttggagaaaatcaaatactcataatttagcatttgaaactgaccttcttcaattggaaattgcatccaatcctcttgtagtttttatattttaaaacataaactattttcaaggtaaatagaggcaaataagttattggaaaaagccataggcagaaaagtaggccaataattgttctaatttttcctccatctgttattctaaaataagttatttctcagctcctacctgttcacttgcagggcctggaaatatttcataatttgcagttatttgagtccccagaccatctctacttttttgcccactgaaatataacaaaaacccctgaatgctttagggcccctgttattaactttattattaattttcctagtccgtgtcacacccagtctttccatttttttttcttacatcttttccaactctgagactcattcaaaatatccacatgactaagttatttttctaggactcagctccctacattacattcttccagtaatctttaatctctctgggtcaaataaaatgattatgacttttcagagttaaccaataggccccattttgcttgtcttctcttaccatctctgtgatttagctccagccacttttgtattattatgattcttaaaataatctaaatttttaagatagccttttctcaacccattccacaatcaactgctctactctttcctgtttactataaatcatttcttcaagaggcattctctgacttctaatttctgtcctgatgactcagccatcttgaggatagaaaataaaatacattcttttaggtataaaaagcaaaaccaatgttttgtatacagtcctgtaatagaggaaaatgtagtgattatataaagtctagtcagtataaaagttaaatgctgtaaaggagaatgtgttggataaggcaaagatgttttgacaggtacaatactctttagtaattcttttttcccgtcataggacccagagctgaggttgaaatttgtctttgttacataaaggaaaatatcaaaattttgagttaaactgtcttgagagagagattggaaataattttctggcaggaactgcaaataagcttaagtgatcaaattgtatcacttccttttgaaaacttagggttttttttcaattgaaaggtgactaaattggcaccaacaattgtctactttggatttgacttttttggggaacaggaattcttgtcattttatgtaaagaagaaatatatcttttccatatgtagaatttcgttcagaagaaatgttatttttcttatagtgttattaacatttgctccttaatgtaacactcatgatttagtgcagattaggaacaaggagtatatttatgtagatatatttgctccatagatattattttctcagtgcttttgcatggagggtgctttaatgggttgttttaaattaattattctctgctttggggaaattagcctctgtaagggatggtagtgacattgacaaacttaggcaaagacagagagaggtgccaactagcacatgtagtaattttttaaaggctgtatatgagcaccattggaaagagaagatgataattttattgaatcaggaagggatctgtgaggagggtggggttctagcaactatttaagctacttatttaattaaggcataatctaagagggatgtatactaaatgtagcggcacagcaagaaactctagagttgaaatggggttattaactaaaggggggttgtatataggtttgtctggatgaaggagagaggtgggcagtagagggaaagtgagggaggagcatgagtaggtggcacaaaagtacaagaacaaatctgcatttcacaaagacaataaaactctcatcatgtcctgagtttaaataaatgccacattataaaactttagctgccaaaaataagcccacaaagaatgtgtattgaattggtacagctgtttcaaatctgtttttcaggaatgatttgaaaataatgttaaattattttgaagacaaatcattaacatgttgttagatatttcgaattttactgaaccaagttcttatatgaagaatggaaatagacttttaagtattaatactgttcttaaagcaatgataaattatcatttttatttataacagagcaaccctagattagggctcaatttgttctttttttttttttttttttttgagatagagtcttgctctttcacccaggctggagtgcagtggcacaatctcagctcactgcaacctccgcctcctgggttcaagtgattctcatgcctcaacctctcaagtagctgggattacaggcacccaccaccacccctggctaatttttgtattttttagtagacacgggatttcaccatgttggccaagctggtcttgaactcctgacctcaagtgatccacctgcctcggcctcctaaagtgttgggattacaggcgtgagccactgcacccagcctcaatttgttcttaatgacttttagctttctatgtgtcttccctgcagtacctcacacataagggttattgtgaagaataaagttattagcttctaaaaagagtactaaaagagtggatcatctgtactaattttaaaaaaggttgggggaagggagtataaagtaatttgaaaaaaattgagtctaaaagttttaattgttcatggctttttattgtttagtgtctgattaaaaacagcaagtatagtcttcaatgtggaatcattgtgttgaattacattcggtgagggaattcacagttttcatgtatagcataggcctgtattcctcaaaatggtatatttttgtggttgtggaagccaaatgatcaaaagaagccaaagagttgtgttttttttgttttttgctaagctttttaaaacattatattaaaacaaacatggatattatattcatgatgtagaaagcaaaattggcattatttcaaagatgagaccagagacttaacaggaattttaggcttgcaacaggctgtttaaagctgtattctccagacctcccagggctgagtacactcttttgagcaattacagatgcatcagtggaaaagttggagaagtggtggttgagtttaaaaaaggtaaaattaatgtactctgtttccctttttttcctattaccacaaggcacaaaatatgaccattttcagtcgaggtcatgataattgtagcatcttaattttgtttatttgtttgatccatacacctgcagtcaggatgaattccttgaaaataaatctcatccgatctcattctctcacttcttaccctcatcagtttaaaacaatttaatgacttctcattgtttttaggataaaggtcaaagtccttaacatggcctataagactcttgaaggtttggccattgcctatgaggtaagcgtcatgcccagcaccaagtatgcaggctgcctcaccgtccttcctgtttgcctaccactggacatttgcacttaatatgttccctatccctcttcacctagttaagtcttactcacccttcacgtcttaggctttttctcatccaccttaggaaagcctttccagatttgttaaatcacatcaaatcctcagttatatgctgtcctagtaccatgtatatctcctgtgtcccattcaccagttttatttttatattaatttggatggttatttgatatccaactcccccactagatgagtgcagggaccccatctatttcttgtaccagtgtgtaaaaaagtatctggtatgaaataggcacttagaaaatatttgttgagagaaggaataaattaatttattcacagattactggtctgtcagcaaatctgctttcctaaatgacaatgcacgtaaagtcccttataatgctctaatggatacttcagtgccaacttgtatattgtgtgccagaatacagtagaagtagggttgctttatccatttctcatagttgtagtgctctagccaattcaaagatacgaatcatggtttaaacttattttgttacaaaatattaataatttcaggaaattaataacactttggtgtttatgccatattataaatagtataaatattacttactaatatcacttagtaagacaacatgataagcaaatacttattaaaacattaaaacacactccttctcctaagcatttatttcccttcattcaaattttctaattgtttcttcatttgggtattttttaaagaactctatatatcttagaatgcatgatggagtgaaattgatcagatgtcttaattttgtcctcataaaaataaaaacaaaaagctcatataaaaaattaaaatgcattattctgttgtgaggatatcctttatttgttaattgggacgataaaatggaaaaacaacccttgggcttaatgaaaccattatcttatttattatatttagtgttcaatttgcatttttattaataggaatacaattaaggtatttaaaggtgcatcttaaatcagcattttcttgtgtaatttttcaccgttccctctgattttgaaaaaaagaaaactttaaaaactagatgtaagtttatcattactaatttttgaagggcacttgttaagaacatacgtacagaattattgcaaagcatagtttgctaaatacaggtgcctcaagtggattttctatgaattacatgctgctagataatcactagtaggcaacttaccaaaatttttctaataaagcctgcctcctcccaatttagaatcattaaaatacaaatcagagtaagtgaaattgtaaagatcttaataggcatgccagtttgttaactctttataaaacaccatcaggcttaaatgctctagctagtactgcaaaacaatggattgcaattgtgccctgatttgacttgcaaacaactattctacaagatggaatttttaaattttaaagatgtatttaatttattgtttgattttaatttaaatcacaatcattaattctaatggaagttttcattatcttactcttgcaatttcaggaaaaaagagtttgttgctatttgcataaatgcattgaactttaaattttactaaagtgcagtaataactgttttagctctctttgttcatctgttgactattttaccacaacataaaattgtttgaaaaatcaaaatttatttagtaaaccaaaacttgcactgacaccaatatatgatagtttgtcatgataaaaatattgttacataactaatatcaagtatagcatacatgactcttatgtgtttacttggcattaatgttcttagaaattaagtaggttggatggtctttagatacagtggtagataagaagaaacctcattaaattagttgcgtttttaaatgttgctcaatatctttttttttttttggtgtttgtttgaactttttattttgttccagatacatctgctatttttaaaacaggcttgcaacatgttttcttaagtaatagctagaacaaatcgatggaagcctggcttagatcctagattttccttttttcaacttatttaccaaagattgtaaaagaatctattttctagtaacttgttagttatacttagcaatgtaatttattagtaaaaacctttaacaatgctggcattaaataatacagctgaatgattaatgttaacactggctgaatttttgttttaattttggtgtgttttttatgtgtatataggaacttattttgtatattttttcagaaaattgatattttaattttgtgaaaatcatttatattttggttttcaaaacaggccattgggatattaaatacatataacagagaaagtgtagagattttgctcatgatgctcaaaacagacatatagtagtccagtggctagttttcctcctggcctgctggaacttacgtagaaaccaagtttgatgtggtatagagctagcatgatatggcagggctaggtgctctttccccatttcctattatattggtgtcaggatgagctttgtggcagtctctgttggcactaatgttacattaaatcaaaggaacaaggcttccttatccagaagcctgctctgttgccttctagctgtcagaccagagactttcagtttgatgttgaattgacacacacagagtagttagttctgtgaaatatttgggttagatgatttttctttccagtggccctagacataatgctttgagtttatttatggtaaaaacctgttaattgagattctgtttatttgggatttgtgataatttcactgtgctcctattgaagattactgttaatatgtgaaggaaaggtttgctgatcaatctaataatgcaaacaagattggaaagaaattgtttgacctgggagaatacaatgtttttgtactatactttgccaggagccacttacatactgaaaatatgctagttagaaaggagctgtatttttacttagaatttctgtatacttagaattatcagtctttattttttggagtattttccaaacattatttaatatagcttggttcttctcattcacccaaattggaaaggtcatgtacttcacattatattattgctagtaatctttaaaagtgagataagggagagttattaacacctttttataggtaaagtacagagaagttaagcagctcaacagagattgtacagctgttcagtgaaattaggtttgacgtcaacttttctcctactggattggatttacaatttagtgggcaaaggacacaattcagataggtacacaatggttttcagaattgaccttttaaaatttttttctgaattttctaccctttaaaaattggcataatatgtaatatagtacaggtaagagcactttggaatcatgatacctgggtttgtatcctgactttatcacttcttagcttgtgtgatcttagggagagtttaagtaattttcccaagttttctcctttttataaaatggggatgctggtattacctacaattaccaatctaaaagatgtttctacattttgccacatttttctgttgtggtatacttaaaacaatgccttgtatatagtaagcacatataaatgtcaacttttttaaaggaagagattatattctgttggcaatattcagaggcagaactaataatagattatatttattaagtgcttactacatactgtgtcctgtgctaggtgctttccctacattacatttaatgcctgtcttagccctgaaaggttggacttaatccctattttacagatgaaggaactttggcttagagagatttttacttagaaatgttgaatgacttgtcctatatacctgtatatttattaagcaggtgtttgttttaagtattgatttctgattggttccaaaatacctaatatttccaccttgcttttctagcagaggtagatgtgacgtgagaggaatcctggaaatacttttcaaagatgtgtatgtcctctccatcagacctaccttctctagtatctggtaaggtgggctatagtttttgtgtcctttgggcttctagtgagatgtgcgtgtgcgcgtgtgtatgcacgatgagttgtttctacttctcaggatagggctttcattagtgacaaagatgccacatattactgtagtcttggtgacagcttttgtattttgaagtgacccctagagtttgatgttcccctctgctgagtctggatgtaggcaaaaaaaaaaaaaaaaaaaaaaaagcctaccctgagcactactgccaagaacccagtgctgagatgttttgttatcaaaggattgttaatatgtggtgcctgataatagacattcataagtatatcacattttaccaaaaataatgatgttttgttaagatttactcagcagtggttagccttgctacctgcatttcattagtgtttctttgaacagcagacattttttggtgcgttcctatggatccgaaacccttatatacctacaaaatgttaattcatctcctcaaattgttttgtttggagacatttatcatagaccaaattgtgatatgataggaaagtttagtgaatcacgaaagcaattttaatgctagaggaaatttaatcataattagttaaaaaactattgtgaaataaatgcaaaatatggagtggtcaagttgaattagagatatttgaccaatggagtgcttgtaaaatggtaatgaaaggcacaattccatctacattatatttgaaagtgatacacataattttgtatatgttttaaaaatatgtattctagtatatatgtggaaacttaagtaggatttgttcaaagttatgcaaacatgatattttctgtttctccttgctttcttttaatagaaagagttaaggtgagtttgcttcagactggaagtgttaaaataagtgaaaataacttaaattgttctttacttgtggagagaatggtttgaagtttctcactttttataaaagctattacaatacccaggacaatagaaccttaaaaaaaattgtgaactgtggtagattaccaaccactttgaagttaccttagtcttgtctctctgactctgtaaagcacctttttctcctaaattgctcattatcctttaaaattcatatgaattaaaattaattttgtttggggatgtttttgagaatttcatcactttctttgaaataattgttgacaccttgttttaaaaaacaatctggtttaaatatggtaatactgtgaatctccatctacattaattttaagatgtatctgatttaatgtttaaaggcagtggtttcttatgtttcagattttcaaatgaagctgcttattcttaaacatatgcatactggaaactaatgcatgcacatagaaaataaatacagcagcgggctggatgtggtgtctcatgcctgtaattctagcactttgagaggttgaggtgggcaaatcacttgagctcaggaggtcgagatcagcctgggcaacatgacgaaactctgtctctacagaaaatacaaaaattagccaggcatggtggggcacgcctttagtcccagctactcaggtggcagaggtgggaggatcaccagaaccaggaaggtcgaggctgcagtgggctgtggtcgcgccactgtactccagcctgggtgatagagtgagaccttgtctccaaaaagaaaaagaaaagaaaagaaatacagcagaatagctgaggaactataacactattatcacgccaccgtccattcattccttaatatcaatatctgtatgtacaaatttctagtttcataaatgtcaaacacttttttttcttcaatcagaacccaaatcaggtgcacacattgtagtctagctcattcttttttcctatgtcaatctttttggatgttttacataacagatgttatgtaatatctcctgaaataaaattcagataatataacctacctagtcacataatttttttaaaactcactaaaatgcccttattgtaataaaaagaaaaacacataataaaataatatgggtttctatatgtacatactcagtatgactatacaagaagaaaataattgatatttttcctacttttttttttgtttgagatggagtctcgctctgtcgcccaggctgaagtgcagtggtgtgatctcggctcactgcaagctccgcctcccgggttcacgccattcttctgcctcagcctctcgagtagctgggactacaggcgcccgccatcacgcccggctaattttttgtatttttagtgtacacaaggtttcactgtgttagccaggatggtctcgatctcctgacctcgtgatccgcccacctcagcctcccaaagtgctgggattacaggtatgagccaccgcgccaggcctatttttccctacttttaatgaacatatctggatttaaaagaagtgttaaaatcagaagttgttccatagagtgtacaagagaaaatggaagaacagatgaactaatagacagtgaagtaaaaacaaatattaggagaaatgttaatggaccagactcatttgatgagccattctagtaattcctattgaacatttgaaagtcatgagtgaaggaaacagctttttggagaatgttatattctagggctgggatagggaatatgcgagaagagcctggagcatcctgtagtgccataaagtaaggaagtgttcaaaaaacacaatgatgagggcatgtaaaagactgaaaagccaatctgaaagagcttccaatagctaaagctggaacaatttgaacaataaagtattacagtattggattataacccaacatataaaataaatatattcatggatccatcctgatagatagaaatgtctagataagtagagaaatggaggagaagagacaaatcatccatgtagagaattacaaatcatttatatacatactccctaactcccaccacaaagaggtggcacttaaatccccactccttgattgtaggttgcatttagtgacttgtttccagagagtagagtatgaaaaaggggaaacatacaactttatagtggagaaacctggcagttgctaccttggccaagtgatcaaggttaacatcatcagtgataagtcatgttgatagcatgtacccatgatacgatgtgatatgatgtgatgtgatatgattgatatgatatgatgagaatggttctttatctctgtggtctttctttactccccacaaacccataaccccattctaaccatgagaaaaacgtaagaaaagcccacatttaaggacatttttcagaataccgaaccaatactccacaaaactgtcaaggtcaccaataacaaggaaaatgtgagaaacttaaaaaccagaaaaggctaaggagacatgataattagttatattatggcattctagataggatcttggaatggaaaagtacgttaggaaaaataatgaaatccaaataaagtgtggagtttagtttattattagcaatataacaaggttggttccttaatgtagtgaatgtacatagtaatgtgagatattaataataggagaatatgggtgaagagtatacaggaactctttatactattttttgcaacttttctgtagatgtaaaactattctgaaatttttaaaaagttgttcaaataaaaaagttacagtatttttcaaatttggtaataccaaaagataagctatgtctcatatatgaatagttttgttttgcctctctggaagtattaataatgaagtctttcaaataaaaaagggcacttgggatatagagttgttcttcactatgtgggattgttccatccatggatctagcaatcattcagtaacctaatcattgtgataacccagtactactcataattctcaaaatgctcccaggaaacaatattggccctggcctggcatcaggatccctggccttaccacttttcttttttgtaaaccttatagttttccacgtgtgaacattttttaaattttatgaatacatattgttgtgatttgaaaaataattttattgaatgaatgttatactttgttttcattctactaaatttaatcttttatttgattagcattttttaccttttgctaatcaggaaatatgtttaagaaaaggagattaaatgtacatggataggatggagaccaccaaaagttagctccatcttctcattttaccttaatgctaaacaatttgcaattaaactctcagacagaagagtgtgctattctaaacattgttaacaaagcttgactcccagtgttccttctaattgtagtttctgtttcctgtaggcaatttgtgtgggaatgttaagcaaggcatgataatttttaagtaaataaatcttgtggtttataattgataatcagctgtatatataaatgtgtgtataaatatgcacacacatttacttagggcagatatttagttacctagggcagtatattagtctgttcttgcattactggcataaagacctacccgagactgggtaatttataatgaaaagaggtttaattggctcacagttccacaggctgtacaggaaacatggctggggaaacctcagaaaactttcaatcatggcggaaggtgaaggggaagcaggcacgtcttacatggctagagaaggaggaagagagcaaagggaaaggtgccacacactttgaaacaaccaggtctcatgagcactcactcactatcacgagaacagcaagggggaaatccacccccatgagccaatcacctcccaccagggccctcctccaacattggggattacaattcgacctgagttttgggtggggccacaaatccaaaccatatcattctgccccggcctctcccaaatctcatgtccttctcacattgcaaaatacaatcatcccttctcaacagcctgccaagtcttaacttatttcagcattaacttaaaagtctacagtccaaagtctcatctgagacaaggcaagtttcttccatctatgacactgtaaaatcaaaaccaagttaggtacctccaagatacaatggggttacaggcattgggtaaatacacccattccaaaagggagaaatcagccaaaagaaaggggctacaggaccatgcaattctgaaacccagcagggcggtcattaaatcttatagctccgtaattacctcccttgactccatgtctcacatccaggccacactgatgcaaggggtgggttcccaaggccatgggcagctctggccctgtgtctttgaagggtacaacccccttggtggctatcccaggctggcactgagtgcctacgtcttttccaggtacatggtgcaagctgttggtagatctgccattccgcagtctggaagatggtggtcctcttctcacagctccactaggcagtgccccagtggggactctgtgtgtgggccccacatttcccccccacattgccctagtagaggtcatccatgaggtctcctcccctgcagtagacttgtgcctggacatccatacatttccatagatcctctgaaatctaggcagaggctcccaagcctcaactcttaccctctatgcacccgcaggcttaacaacatgtggaagctgccaaggtttacagcttgtaccctctggatcagcagcctaaggtgtatctggggtccttttagccgcagctggagctggagtggctggggacacagaaagcagtgtcctgaggttgtacagggcagccaggctctgggcccagcctacaaaaaccattcttcccttctaggcctctgggcctctgacacgaggggctgctatgaaagtttctgaaatgcctttgaggccttttcctcattgtcttggctattaactttcagctcctctttacttatgcagatgtctacagctatcttgaattccttcccagaaaatgggtttttcttttgtaccagatagtcagactgcagatttctgaacttttatgctctgcttcccttttaaatataagttccagtttcataccatctctttggtcatgcatatgaccatacgctattagaagctaccaggccacttcttgaatgctttgctgcttagaaatttcttctgccagataccctaaatcatcactctgaagttcaaagttccacagatcccttgagcaggggcataatgctgccagtctccttggtaaagcattgcaagagtgacctttactgcagttcccaataatttcctcatttccatatgaggttacctcagcctggacttgactgtccatatcactatcagcattttggttacaatcattcaacaagtctctaagaagtccaaactttccctcatcttcctgtcttcttctgagccctccagactgttccaacctctgcccattaccaagttccaaaactgcatccacatttttaggtatctttatggcaatgccccactcctacataccaattttttgtgttagtccgttctcacgttgctagtaaagaactacctgagactgggtaatatataaggaaaagaggtttaattggctcacagttccacaggctgtacaggaagcattgctggggaggcctcgcgaaactttcaatcatggcagaaggcaaaggagaagcaggcatgccttacgtggttggagaaggaggaagagagcaaaggggaagatgccacatacttttaaacattcaggtcttgtgagtattcactcactatcacaagaacagcaagggggaaatctgcctccatgatgcagtcacctcccaccaggcccctcctccaacactggggattacagttcaacatgagatttgggtggggacagaaatccaaaccataccaagcagttttgctgaaatcgaatataactcaaagaccttttctgattgtttttaatcaaggaagtcaatgcttttcttcttgtcattaaatgtggtaccttattttcatcttataatgagtccgtgtagtgcatttagtagatgagtttgggttatgaggggttgtaatttaagacctcctctgttcacatctccaagaaattacattaagtttcaaaactttatacttgcccttaattcttgtgcctttctgattaagatcttccttgttttttagtttaatggtgtgaaaattctaaaaagctcagtctttggtaatcagtagataaagaaactgacagaaaacttaatgcattaacctgatacttcttttctttccacaaaaaattgaaatgttataattgtcacaatttcaacttacttgattctttgttattaatacctctctgtaaaaatgtgaagttctgttgacattgttgaggtgaatgtcttaaaagtgttgccctgatttgctgccaaatgtctttttctgatttatgctctgtgagtaccagcctagctatgcattaatgtgctctctgtgaaatgcttctgctttttgtacaaactattcttaagctatgctcacgggaatgaaggacaggttgttttatttcaataaggtaagaatgctttacatttaaagaaagcttcaaaaaacaacctgtgtcaattatacattaaatatcaggggtttgaaaccagttttgaatatgtgaccagaaaggatggtttgacttttcaaaagaatttccaatatcttaaaactttagaatttatctcgggttaggtgggcaatgtttagactaagttgtttcaatgctttccaataatacttttcataaaatttcacagatttagggtggctagctattgcagtaatacagtcttataataattaacgacagaatgttagaagcaaattgtgtgatttgcatgacttatgaaatgcagatggtgagaagtagacttggaagctttttcagggtgcagatggacacaagttcttcagtgaagttaattaaaagtaatcattgtatagtaaccactgtcttgtaggctgctaagaaattagtattctactttcccaaatgaaaatgccagatgatgcctttccaggctgtgggaaatatctttatcacctgtagtcatgtcaaaagacgcattcctcttcccctttcttcctccatctctagatttcatacagatgaataaaattaaagggacaaatactagtaggaagcactgtatatagaagacaatacaaattatctgtagtactaagttgggattggaggttgtggtccattccacatcctgtcctgtatttgtatgtgtgtttaattcatgtgtttacttctcaaaccctttattttaaaatggagataattaaaatgtgttttatagtgaatagctgaggaataattaatatatagtccaggcagaaatggaataacattctgacattggcaaaaaagaatttattactgtacaggatttaaaatgatcttaatggaaaagaattttttaagtattccagtttagaaataaattactagatatagctcacatgtgtttgccttatgatatggcatgaaaataagattatactgatttaaaaatgcatctgggttatagatttcaggtggctggctttgttttgggaactctttcccttttactaacttctgtcatgtagccacttctttttctaacagctgtattggagtgtttctcttcgagtcaatgtttttacttatttgagtcaaaagactacttaactaattttgcctagttattagaatggtatattccatttttcctgccagggaactcaatacaaaggtcctaaagcattgttgttgatgggtccaccaaacctggctaagtcctgaatcagtatagacctcatctcagtagtaaaccgtgtatatcacagtcccctagtacttctcagcattattttatcacaaagtttatgattatttaaattttatttctcaaatcttgtcagaagattggaatgtaagagttttattataaaaggtttattattatacatagtgatcaaaattattattaaacactgaatctgtgcaatgaaaatgataggtacttagcactagagctccatttaagtgacagaaatgtattgacttttcataggaaaaacaggcaattgtaagaaacaaatgaaccaattcgtttcagcttggatcactgaaaacaagagagaatcattggcaaaacaatgccttctcattcatgtgtcacaagtggtacttggattgaggacaattgagaagcattaagactgcaaattagttcccaagttgtgtagaatagttgtttgaaagtgtactttcccaaagctcctatgccagcttttaattttcttattaccagcagttttgtttttcttaggttttacattttggtctgcatttgtgttttccttataaaaatgctctatatatccaactagtacatcttgtgtaaatgatgtcaactcatatataagacttcattttgaggaattttaaaaatacacaaatttattaagagctttcttttaatccgtataatagtgtaacaatgttgaccttaaagcttttcagaaatattcaccatgattttgttattactacttcttcaatctttttgatattgacatgtttctaaacgacagtggatagtaagatgtcagattttatactttcattcaaactttgaagaccatttggattttttgggatgatcggctctgagccattcataactcatttgttaaaaacacataagtcttcgagtaaatgaatgccttgaaaaaaaaaagagatcatgtggttgagacagctttacttctgtcagggttacctatggtagggcaaattatttgggtttctggttttctttcctataaaagaaagttggatgatatgatcttaaaagctgtaagatttggtgattataagcttttaaattcatgttcatacttggtttataagtgatgaatgataaacattcttgattttctttacatctacttttatgaccaccagtgacagttgggccctctgaatttttcagtttaagtttttttctacccagtaattaaatgccaaacacgaaactgtatgtgctttacacaaagatttgctatgtaacaaaagtggaagatgtattttttatgttttaggtggatttgaatgcccacagatctaggccaccaatgccagtttacctttacagattctgtttggcaaattcctaagacattaggttacaaatctttctcctttctcttttttctttcttttttcctttttctatattctttcaccactgaaaacttttaacagttacaggttagcaagcatatcattgagcaaatgccctccagcctcttggagagtcttaactattcacactgtcttctctgcctgccccttggtaatatacaaaaagtttcaggtggctgaagccctaatatattaaaaacaaaaatttgaattctaaatacacctgtaagagcaaggaaaacataaattagaatatgtggtatatgtaaattgatatggagtatctgaaaaaaacagtactttttgttcttggtggtcatatttaaatcatacttttaaaatcaaaagtctgtgtaatatgatagttctgtaagttatatctagatgtctgtgaatgcatcaaacagatttttttaatgcatggagtacaagtacaacctttaagttcttagtgaaatttatgcctatttttatcaaactttaacatgtatggttttattatatttaatgggcaaatttgaagcacaaactcaaatacagttcttgtgtccgttattgaaacacatcatcatttaaaacagtttgtaacattttcttttataaaagaacatgctctatacactgacactcttgttctctgcacaatctatgagatgaattgatagctagaatgagaacaaacttttagaaatctcttggccctatgccctcatgttacttgtaagcatctgagctcggagaggttaaatgacttctctaaattcatgtatctttctagtagcaaaattagtatggcaaataactcagtatgaaagctcagaaatagtatgttgcatagatcttttcattgtgaggacatcctctattagaaacaagagaatgagttcttttgatcactggtgtcaaagttagaacacgtctttattaacacatgcaacaaacctacttcatagaataatcccctcattagaaatgtttgttttagatttcattttatcataactgaatgtaagattctgaaatgccaaaccccatttatagttaaaatgctattaactgctagaaaatcttctcctgatggtcttctaatctctgtgggctatgactcaatgattttaaatctcattttctaaagctttgcagattgttaacgcagtccagtgcaacaggattaaacacaaatctgaacacaccgtactttttgaggtccgtttagagctgaataagtggtttgctgtgctgaataatttattgtaattcactttaataattttccattttaattatgagcaatatacatgcacctaaaactcttaagtgtgaattttttgacactttaacccttagctgtctatattatttaagtaacctcattcacactactggaattaatatattagaataaattggtcccttgtgttttataatacaagtagctgtctatgatacaccaaaaaagtacatttgataccacatgttctcactcatatgtgggagctaaaaaaattgaatacatttaagtagtgagtagaattgtggttactagaggatgggaaggggagtggggatggggaattgggataggggtttgggagaggttggttaatggatacaaaattacagtcagatgggaggaataagttctagttttctgtagtactgtagggtaactatagttaacaataatttatgttttcaaatagctagaagagaggattttgaatggtcccaacacaaagaaatgataaacgtttaaggtgataaatatgctaattaccctgatttgatcattacattgtatacacatatcgaaatatcactctgtagcccataaatatgcacaattattacatgtcaatttaaaaagtgcattttgaaagatcaaggctgctgaattattttaaaatttattcagaaagcttattgattttgatgtcctccttttgtacctattgtatatattacttacttctatatagtagactttatatcatttaaactgttctgatttctgtctctttccaagattccgacatcctagtgttataaagcctcaacaattggaatctcaggttttacaaaaatatttgtttaaaatgagagtaattatagcagtgtgatatctgcatttatcagtgctttgataaggtgtgtacattgtatgcatcatagtgaaatttctggtaattattttaataactaaaagtatttaacaaaatggaaacaaatacattaatagatttttcaaatttaatatttatataggtctcttgtactatgtgtgctgtcaagtattcaataagtgaaaatataaaatactttttttcaccactataatgtcattgtatgatttttattctacatatttctctaatggtacttgctatcttttacaaactacttctgttgcatgttaatttttaggtattgtatttttcaagatttatcatcttttaaggaaggcaaaaacatgtaacttaatcacttgaaagtgaactgtgtcattatgcacattttctgatagctgctgtcaaagataaaataacacttcctgccaccataagaagtgtggtcacctcaggacagcactgagtcatacatctggggccagtaggaaaagttagcatcattggcagccgcctgggctcttcatgttccatggaaaatggcacactggcgcatagtgtaacttaaatatttctcaaatgcctaactccttggaaaaattaatgttaagtagtataaaaactgaaatctatgactttatattgaaccagcggttttgagttcttaatttaattatgcttgttccacccatttgtaattctgatttagtttaactaaatttaaattataacttgatatgttaaaatgaaagcaccttgtatagtaaagaacttaagaattgagtcgttactgtatttttttttttaatgcgttaaccactctcaacctaggtagcactggaatatgacccttaatgttttttcctgtctttgtaagatactgctgttaaaatttaacttagatctctgctggacttggaatctatatgtatatctaaagtatttatgcaattatacagaccagtaatacaatattagaaaacttggttgattacccttcataaataccagtagaatttggaagtacagaaactgcccacctccatccagtcaaataaataacctgaaagcataaacgctgtttagaagtgttttcttaatatgacttcaacatacttaaaataagtacctataaaaaacaaaatctttaatccaatggctactttctgagtatatattatcaggttataccttataggtattttttatatggaagtaacttgcatatccttcaaatgaaaggaaatttattttacagtcagtagtccctctatctttgtagtcttacttgaaacacatagtttactaattataacagtgctaattctgtatgtttgggtaatatttttatttgtatgtgagttagttttttaatagtaaaataaaacatgttgctacgtacttagatgttttaaaaattttctctaaacgtttaatccattataaaaacctcttaggatagtgcagttattcttttcattaggggatcagaataaccccattctaagttttgtcagaatctttaagtcacattaacttgtacttccaaagaataggcctgtcagggctgtctaccgtgactattgtataactaactaccaccagcatacatcgtcactacattacagtgtggaaaagtgtggcctttgaagccaaatacacctatatttaaatgccagctttgctatttattggctgtatgaattttggtatataataacctctttgagttattcaattttctcatttttaaaatgaagaaataacacctacctcaaagagtactgaggtttaaatgacgtagtctatgtaaaagatgtactaagtcactggcacttagtacattctagttcagtgttggctattattagtaccaccaccacctataaagaagagttgtagtcagggggtgataatatatgcaaagatcatagtagaagctaattattgttacaaccaggcatcatgccagtaacctgcaattaattaatactgtaattgaagttcaatgaaataatgtatttttgaggcattccaatttaatttcactgaaattacataacgaaattagagaaaaataaaagattaccgagaaaatgtatatagaaataaagagcccaagaatgggcagctgaactcaacatggcctgctcatacaaaaatttctgattgtagagtgctttgtcttaatatacttggatgccccattctgatcattaaaaaaagtcatacttctgaaatgtagaactccacataatttccatttggttatacatgatattttattaggacttagcagtatctgaatttctgaagactttaagaatagtatttggcacatgggcacaataaatatttctcaaatgaataaatgaaggaaatcaccctagttaataaaacttgatctcaggcaactgctactactcttaaacttttgtgtcatatgtaaatttaggggcacggccagaaatattgtaggtctccttttttttcctcttcctccttttcaagacctaagaaagatacattttatttaagatcagatatttcctttttatatgtttgtatagattaaacatttctattgaaaactgttctatgaacaaaaagttcataggttgttgcctgaatgaaaaaccaaatcaaaatatatagagaaaatatttttcaatgaataaaatgccttaattctttttggacaaacttgcctaaatttagaggtttcattatgtgtgggctgaaagggcagatgaaagatcacattttaaaattttatgtttcaatgactcctttctttcttacttccttacaagtgttttgcagtgctagaagtatgcaagtagagttttaaaagattttagtcctttttagctttgaagtccaggaatttaaactataccttgttcaagcttgttccttttggccaagatatatctttgctgaacaatgatttgttaaaataggatttctattataagccaggatgtcagcaatactaatagtattagaatgaatgagcttagaaaactgggttaagaaatgatcaggaagaaagtaaggaggttggatagtccactataaataatattaaaatagctgaaaattttctgtaagggtagatagcaaccttttgactttttaatgttatgtggttaaaaaaaatcgtgtattttaaaattggaaataatatgggtttgtatttcttgatcattatctaaatctacaaacatttaaccaaaatggtgatggcatgagctacaaagatctggctctaaaataatttattttggcctttttcaaaaccgaacaaatatcacttctgggttcgtggcacatcatttttcaatggcccatttttcccctttcctttcataattatgtagccctggagtgagagtaggtatgtgtatacatgtgcacctatgtgcctatttcagtagtgtactaagtcctgtctagagtagagaaacctatataacatacagcaatccctatcttttggttaatttcattttaagaatcggtcagagcaaacattttcttttttaccacctttgtttttagatcactgcacagctcattctggaaggaacaaagaaacagaaatagcatagtctttgatcctgggaaacttctaatgtacaataaatgtaaaactagatatttgtacaaacagtaaccattcatgctgtgcctattaagtgtcagccacttttcatactgacttgatttggacattgcagcagcatctctaggttagatgttattaaccaattttaaagatgaaacagattaaaaggacttactagtaaatgacagattcaaaactcagaacccagggtcctctgaatcaatagaccatgcattttctctcaaacatatggtctctcaaattaaataagaacacctacccaatagtgacccttatttttctctagttcatcttacctgagttcaaagaagtgcttttctactgatcaaaaaaggataaaaacagggttgccacatccatacatggttgtgtaggttagcagtacataacctgcacaactctatattgtgtcattggataagtaaggacatagagttgcaaacctagggcaagtaaaaggaatctttataacacccctatttttgtttattcaatagaatttggaaaattagaataaattaatatttttaaatgatttttaaattttcatatttaggtaatgcaaatgtttatgctgaagactatatttgaagttatgaacaacttaggtttaatattttaaaacagtatgtttgtatgattttttcatttttaatctagcaactaatatgaaattttagtggcaaatgagcacatagattatattacaacattttacaaataaaaatacatttttagtatcttagaacgtgaaactagttgacatttaattagctcctatttatgctaaaagagaggataatgctaaaatagtaaataaatatttttatatttatttgacataattttttgtgcctggtttaccgtcttaattatgtttaggacataattcttaaattgatctgttgaatccttaagctcatgattgaggcaaacctattaacaagttcatcaaacctgtgaacaggaagagccaggaaaacactgaaaaactataagggaagattaactttaccagacattaaaatattataaaacctctatcataaaaacagtatggtgctggcccatgcatagacagatataccagtggaatagaatagaaagcctagaactagatcctggcacatatagaaatttactatatgataaaggttgcatctcagatcattggggaaaagatgtttgtccattgccatttggaaagagagacagttaaataccttgcagcttacacaagaatagcctccaagtggattaggtatctaagtgtaaaaattgaagccacaaaagtactaaaaaacccaagatttttacattggtatgtatttctagggaaaatttcacatacaataggaaaattttcttctaacatggcagactctcccccacctcattttgcagatgtgattatttgcaggtaacaggcataggggaaatcagttctccctcagtattcacaatcttgtcaccagctacatgtattctctttaaaacatcactggcaaaattataaatttatgctgttattaccttttaagagtagactcactcctaattaccatgatttgtttatatacattaacaaacagttctaccctaaattttatcatacgaactttagtgtcaattagtctaacttcataaaatatcaaaggtaactccgatttcatgacggtgagatatggaaagtatgttaaattctactgtgactatgactgatgatcgtaaagtttagttatagagagaaaagagttaattggtgattcttcactaaatgtaagtttcagaaggaaaagatcttacataaaatttatagaaacccacaaaagttaactttaaatctatattgaattttaaaataaagcagaaaggatgctcattatgccagcatgtattaaataccttctgtgaactaggttctattctgataatacaaaaatggcatttagtcccatagctggtcttactattaataagtatctgataattaaatgcagaatcttaccctaaataagggttattgactccaatgtgtaagtttctgttctttatacagctgctatgttatatttcatgtataccacatgctacttggcagaacaaagggtaaactacagtacattttaagtaactacttccaaaaaatagcattgtatagcaaacagttccacatgggatctttcattgcagcttctattttcataaatagaaacatgcagcaatatgtagctaagtaaacaaaattgcaagaatagcttaattagttgaaagatccagtgtacctaatcacttacctttcatagaatttgctttgaagaaaaaaaatagcctattctgggatccatagaggagagatgcaagatgcttctataagaaacagtggctcactaaagcctaacttcttaaggagtaaagcaggagaaagggggatgatgagattttatcagaagctagggtttatgtgtgtacagtttttaaaaagtcccctaagtgtcttttaacaggacgatatttaaaatttaatgttctgtctgtcattttttcccttttgtggctactcgttgtatcttgcttgggaagacattttccatccctatattatataaatcttttcctgtatattgtcccaatatattcatttcttaaaacctttagttagctttttattatgtaatttaaaaaaatgtgcagtatattctggccaggcatggtggctcacacctgtaaccctagcactttgggaggctgaggcgggcggatcatttgaagtcaggagtttgagaccagcctggccaaaatggtgaaaccctgtctctactgaaaatacaaaaactagtcgggcatggtgatgcgtgtctgtaatcccagctgcttgggaggctgaggcaggagaatctccttaagccgggagtcagaggttggagtgagccaagagtgtgccactgtactccagcctgggaaacaagagcaaaactctgtctcaaaaaaaaaaaaaaaaaaaaaaagtacaatataaagtagaggatctgacattacttttttcccagatggagagccaggcgttctaacacaacttatggggtaattttcccctcacttatttgaaatgctaactttataaaaaatcaaaatgataaacctcaattatgtaaactaaaatacaaatgcataggtctgtttctggattcttcctttttggatatatttatccattttctatttcattggaattttgaattattgttactttatagaatgtttgctatctgaatggcaagtttcctcacccccatgttttactttttcaaatatttcttgattactgcccatttttcctttcatgtggaatttaggttcagtttgtcaaggctcacacaaaaataatctcattaggatcttgactaggatttcattgaatttataggttaatttagagaaaattaatatccatatactattgggcattcttatccaggaatgtgctatactttcttacttatttggatcttcttttatatccttcagtggaatttgatagctttttaaaaaataaatgtcatctacatttctctttaggtttattcctagtttattggttttttacctattgtgaatagaatttttttcattacattttctaattggctttgctgagtatggggaagttattgaatactgctcttgtatttgactaccttaataaacttgcttattgttctgtgtttttcagttgattttcttggtaaattttctttggttgattttcttggtatttctaagtaaataatattatgcatatgttgatagttttttatcatctaatatccataattctttttcttccctgtctgcgtttgctaggaccactgctcaatgttgaatattcttgatctttagttagtaagaatgctgcttgagtttcactattatattgattatgatgattttgaattgttctaaatgtgctctgcatttgacaaggtctggttaattgatatattaactttcaaatttgtaattaagttttataattaaaaataaatatatttatataaaatcctaacggttcagaaaagttagttttaggaaatgatcattcatgattcctgaggcttaagggtttagcttgctgtgtagattctacatagcagagtagcgtgtagattctacatagcagagtagcatatagactctacagagcaggcccagggtccccagcccttgggctatgaaactgtactggttcatggcctgttaggaaaatgggcggcacagcaggaggtgtgtggctgatgaacgagcactacagtctgagttctgcctcctatcagatgaccggtgccattttagattctcataggaatgcacactgtgttgtgcactgagcatgtgagggatctaggttgtgcacttcttatgagaatataatgcctgatgatctgaggtggaacagtttcatcctgaaaccatccccccattgcccacagaaaaagtatcttccacaaagccggtccctggggccaaaaaggttggggactactgatgtagaggatgagttttcatcttttatttgaacttggtgacttagtttaccaagtaacttgctttcagatcttgtaataaaaatgtagttttagccataaaacatctaattctgttttgagctggtagcagtttatatatatatgtactgatgatatgattaacatttttattgaactgctcaggagtctaactatgtatctccattatttagaaattttctgaaaactgtttcatgcattcctttggaaattcataaagtaagcttctgagaataaagaaattgagagatatgaccactggaccactcctagctgggccaaaaagtattccataaagtttatgatctcccctctccattcctttctgtcaagatcagaagaggtaggagtaggggagtcaatatcatgtctctttagtttgtagaaatcatgatttgaaatacaagtttgtaattttcttgaggtcttctgaatattaatcctgttgccaaatcacagatcactttccctgtacatatttaaaggaaatatttttatttcgttagctaatgtaagtcctgttttttaaaaaacgaaagttgttctttatgctgtcttctttttttcttaacaattaaaccatgaaacaaccataagttgaaaagtttcattgattctgctcctcattgtaacagttggtgatttggtggcattagtaggtcatagtcatagagtaacagtactcttctccaatttgacagactaggttaaggcttttggttttggaatatagattagaactatattatttctaaaataaatcttaatgctgtaagatgtttggaagcaaatataaaactgtagttaatgttgcactcaggaattattagaaggttgaagtgaaggacaaaagaaataaattttattacagaaaacatgtctcctaattaagtattcattaactgcccaaagttgaacttgttaacctcaaggttggaatatactctatgtgttggagaatagatgccatagtagaacctttggtagttaagacagatgtacctgggctatatttcttccagagaatactagtttctcaagatcagctattctgtttcctatgctatgctttttattattctctagtttctttttctttttctattgtgttctcacaagattatcaagaacccctcaccccctcctattcaagcagaaattttggttgtttttccctccttcttggcaagatttgggattgtcatgaaaagtaatgaaatcagctcttttatatataaaattttccatggatgacatgactcagttttgaatagaaatgcaaggttccattttgaattctttaccttttttggattatagcactgctaggtcaagatcagagcgctttgttcataagtaaagtgtataaaacgtaacaggaacttaaagtttcctttatcattattgaatgaatcacacacttcttaaatttttaatctgtggtgctataaccaaaagaacatgtttcctgggaggctgctgacaataaaaagtaattgtagattttcttatgttgttacatattttagtatatttcttattttcttttttaaaataaaaagttcttattcactctaggatccttagaaattttttccatttctagaaaaatatcttgaattcagtagcctgctgtttaaagttatcatgagtagtgaactgttgcctttgggaaaggagcattttgatccaactatgcattttaaatagaaagataatattcatctttcccatatacattaatttagaaatgtctaccaatattttctatacctttcacaatgattatttgcaattcttatcaacattagcttttactttttatatttataatatttgcaatatatagtgcaggaaattcccattaacctgtggctactcaggatgactctcactgagttgttggtttctttcacaggttgatttacagctgtcttgagtataattctgtgtagcaggcaatggtagtgtatttatatgtatacagatcttgcatccatcaggttcttctcattgaaacacaccagcggagagcttactaaaagattgtttgcacagctgctttcaggcagtgaccaaaatttcctaggaaagtgagtgaaaatacacttgttgagccaagctcagaagtttcttggatagtgctttacataatataaagtcattacatgtgttggatctttgcccttatctaacctcccccaacctccactccactccactccacgttcttttttgtcttgcttagtctcctttccctaggagaagagcttttgtttacccttttatgtcttgtgaagtcactaaaaaagatttgtcttctcatatgacatcagtatctaaggaccttcaattacatatcatgttagtttttttttaattctgagacctaagtgaagatgatgtccatatatttttgtcctcttatagactcctatctatgaaactaggtttttcagcagtaatgtaatcacaggagaatcgtaagaacattaagctcctttaactgttgggttgccaacaatatgaatgtggtgttaaatcatgtcttggactttacaaatatcatctaaaagttagttcttaaattcctggcaaggaatttacactgtgctaagaaacagatgttatggagattaatttgtgactggagaagaaatgtctctgtggtaagagatgagtacaggttctgggcaatccatttgacttttaaatgtaagaatggaattccaaacacttaacacattcagctatatgacagaaagtaaatctatggatatggtattttgtgaatgatcttttaaataaaagaaaaccttacataaaaaatgaaaaaattatatatatatatatatatatatatatatatatatatatatatatatatatgtctgtcagactgtttcttagtcacagtattagtcaaggtttgctatccactctccccaccatcctgattcaaatgcatctgcagaagtttttgctccttcctttctgagtttcaggtatttcttctgattcctatccacttgtaaaatttggagtctagagggaaccaagggaaagcagtgattacaactgacatcttccagtttgattggtgaaaggagaaacctcacttccttaatgaacattgatcatagtaaaatgctgtcataactcaggagaattttgctaagcagagaggaattacaaaaaatattagaatacatattttcagagttctttgagaaatatttgataaggaacatgaacttgtttgtggtttcttttttgatagagcttctgcaacattcttttagaattaataacagtattgtgaaggttgaggctaatttttcgtttagcctggtgaatttctccacaggcttcacttttgggaaaataaggaagttctctaagtatccataaaacatgaaattagggatttattcaaataaacataattaaaattattttggaatagactttttctctccatttagttgtaataatttgtctagcttacagttcctttgttgtctatagatgtctgagaaatatttgttaattcttgggtatcattatatattttctaattggggctggcaattacaaaaacggcatagctaaataatctagaaacataagcctaattgtgtctgtgtgtgtgtgtgtgtgtgtgtgtgtgtgtgtataaccaattatcattattgtcctatttgatgacttcatcacttattgaaaaaaatcaagtctctttttgcctttgacaagtgttgctctagtaatgtgaatattttggagcttgttagaaatacaaaatctcaggccacactccaactaaatcaaaatttactacagtttaatcagatccccagatgttttatatgcacataaaatttaagaagcaatggaaaactgacattgttttgagtagtaattagaaatttgtaattaatttataattttaaaataaaattggaattattttgagaaagtcttataaattttaggagaataaaacagggccttcaaaataggctgttttcctgggttaagtaaaatttacttcataggtgaaaagaaattatttggcttttaatttcattatgctatgttacaaattgattctgatatataaagcaaaacaaaaaattgagtatcaccacttatattatttttaggaaacatgatcagaaatggctgttgtacgaatgtaggattctttttatcctaacattaaatccttacttgtgataagatactaacattcatagctttattttaactttaatattcaataaaagtaatgatagtttagtgattagatggagagtacatgttgactaagtatttcagttagcctagtattttagaacacgttttaagagtcaaaaaattctaaagcaccaaaggattgtgtgtgtgtgtgtgtgtgtgtgtgtttgactctgtaaacttattgagtagttaataatgctgacattcatttatagtgggcaaatgtgtgtttgtgtgtgtgtgtttgtgtgtgtgtgtgtgtggatttgaaatgatgaataagatttgttttgtattagggaaggatcacaggggatatatttagattaagtttaatagtagatggtgccctttgtttctgcagtacttttatactaaacttttcttttgtggagattatttcagtcatatttaataagatgcatatgtctgaattaatatgatcggctgtaacttctaatggcagtttttttacctctatattactatacagttttttctggaattaccacttttgaaggtaatttaccttttaccacatttttctgttgattttgaattctttttcaggagacaatggatatagttctaaataatgtatgaaataagttctacttgtagatcttttccttaacttcccttactaagaggagagtaagaggaattttagataggcgtagaggaataaaatggccaaagaaagatcatgtgtagaaaagcttcaacttgcatagctaaaatagcgaaccaagtggagatgccaagcacgaagattacaaccaaagatgatcctttctgcggcaaaaggcaaactggccacaagtcactgttctacacgttgaaaccagagaagagtttttcagaacgtgagtctgaacacagccttcagtcatggtggccttctttcagtgcctcatactctcactcctgtctccaagctgctgagtccttgctgttttcagggtctaatactctttcctccctctttggctagttaactcccagtcatctctagacctcagttcttgccacacttctcccagaaaacttactcctgatctctctgacatggtcaaatcaccatattatgggctcctggagcaccatgccaggtacctttactttccttcaattacttgttagggttgtttgtgtgattacttacttaacatgattctctctcaataaactattacctcagtgaaagcaggggccatgtccgtttctgctcacttttcttctttactccctagaataatgcctggctcaaaaataggcattcaacaaatatttgttcaattaataaataaaagttggtatcaggaattagaaaagcagtgagatgagcatcctgatactagggacaggaagggaagcattccttaggaaaatcatatagaagtctgtgttgtagaagaataaagaacaggcagttattgactttggaacctagtttaaatctaaaaatatcaggagcattagggaagcctgggactgagataagccaagattagacgtgtcctcagaagtaaagttggatcaacaagtttgccctttacaatggcaagtctccagcattgttctcattaccacttcctcttacctcccacctggaagactgtctcctcttgcccgtgggcaagtcctccttggagaagatagtttctcctggcaccttggcaaagatgactgactaattcttcatgacacgaattactttaaaattcatctagatgtcatttagatacaaaattcttttttcccttgatatttctagtgtacaattttcagcatgtcctcactcaatattgcttagatattaaatggaaatatttaaaaagatagccgtgttaagtcccatcatgattaggcaattttttcatggtgaattaggattgggtaagacatcatactgatgacttctatgtagaatatgctaaatttagcaaatcattgccactagtggtttctttgtattcaatagaaaagaaaattgtatatctattagtgaagtttgattacacataggtggacatagcattcgtaatcagatgtaaaatagtaacttacagctgtggctttcacatacccatatgcctcccaaaatgcttaggtctaattaaaatttgaaaggagcaaatttaggctatttaaggttaatctgttggttaatttgtacttcttattatagtaaaatatagataacataaaatttgccattttaaccattgcatttttaagtgtaaaatgcacatatcatcaaacgtactatcttaaccatctttaagtgtacagttcactggcattaagtacattcacatttttgtgctactgacctcagcatccattcacagaattcttttcatcttgcaaaactgaaactctttactcattaaacaacaatccctattattcctcccctcagcctctggcagccccattctactttctgtctctgaatttgacgactgcatgacgactgcatgcctcatataagtggaatcatacagtatctgtccttttgtgaatggcttatttcacttagcataatgtcttcagggttgatccatgcagtaccatgtatcagcactttctttttaaggctgaataaaaatgtatacacattttaaaatgtgtatacaacatttaaaaaatatttttaatttttatgggtacatagtaggtgtgtatatatggggtacatgagatgttttgatacaggcatgcaatgtgaaataatcacatcatggagaatggggtatccatcctctcaagcatttatcctttgtgttacaaacaatataactatattattttagttatattaaaatgtacaattaaattattcactatagtcagtcgactgagtgactctactatttgctgtcaaaaagaatgaacttattcattctttctaaatatatttttgtaagtattaaccttctccaccttcccctcacctccccacaccactagccttccctccctttggtaaccatccttctactctgtttaatttttagatcccacaaataagtgagaacatttgatatttgtctttctgtgcctagcttatttcacttgacataatgatctccagttccaaccatgtcgttgcaaatgacaggatctcattcttttttatggctgaatattactccattgtgtatatgtaccacattttctttattcacctgttgatggacacaagttgcttcaagatcttggctattgtgaacagaactgcaacaaactgcagaactgcaacaaatccctatcaaaataccaatgacattcttcacagaaatagaaaaaaaaaatcctaaaatgcatatggaaccacgaaagacccagaatagccactgggtcttctgggacccagtgcagatatcttactgatatcctgatttcctttctttggggtgtatacccagcagtaggattgctggatcatgtggcagctctgtttttagttttttgaggaaccactaaactattctccatagtggttgtactaatttacattcccaccaacagtatacgagggttgccttttctccacatcctcaccaggatttgttactgcttgtcttttggatataagccattttaactggggtgagatgctatctcattgtagtttttctttgcatttctgtgatggtcagtgacgctgcataccttttcatataccttatggccgtttgtatgtcttttgagaactgcctattcaaatcttttgcccatttttaaccagattattagatttttttttttcctatggagttgtttgagctccttacatattctggttgttaatcccttgtcaggtgggtagcttgcaaatatgttctcccattttgtgggttgtctcttcactttgttgactgtttcctttgctgtgcagaagcaaaggaccccatttgttcatttttgctttggttgcctgtgattgtggggtattactcaagaaatctttgccaagaccagtgtcctggagagcttctgcaatgttttctggtagtagtttcatagtttgaggtctttaagtctttaatcaattttgaattttgtatatagcaggagatacagatctagtttctttcttctgcccatggatatccagttttcccataaccatttattaaagagactggccttctccagtgtatgtccttggcacttttgtcgaaaatgagtgcactgtgggtgtgtggatttttttctgtgtactctgttctgttccactggtctctgtgtctctttttatgccagcaccatgctgtcttgtttactatacctcagtagtataatttgaagtcagttctgtgattcctccagttgtgttctttttgcttaggatagctttggctattctgggtcttttgtgattccatatacattttaggatggtcttttttctatttctgtgaagaatgtcattggtattttgatagggattgcattgaatctgtagattgctttgagtaatatggacattttaaaaaatattcattcttccaatccatgaacatgaaatatctttccattttttggtggtttcttccatttcttgcatcagtgttttatagttttcattgtagagatctttcacttctttggttaagttgattcctaggtgtttaactttatgtggggctattataaattaaattactttattttctctttcaggttgttgactgttggcatgtagaaatgctactgatttttgtgtgttaattttgtatcctgtaactttactgaatttatcacttctaatagttcttttgtggattctttaggtttttctaaatataagatcatctcatcagcaaataagaataatttgacttctcattgttcaattcccacctatgagtgagaacatgcggtgtttggttttttgtccttgtgatagtttgctgagaatgatggtttccgaacacaggaaggggaacatcacacaccagggcctgttgtggggtggggggaggggggagggatagcattaggagatatacctaatgtaaatgacgagttaatgggtgcagcacaccaacatggcacatgtatacatatgtaacaaacctgcacgttgtgcacatgtaccctagaacttaaagtattatatatatatgatatgtatatacatatatacaatacatatatacatatatacacacacacacacacacacacacacacacacacacacatatatatatatatatgaagaataatttgacttcttcctttccaatttggatgccatttatttatttctcttgcctggctgctctagctaggacttccagtactatgttgaataacagtggtggcagtgggcatctttgtcgtgttccagatcttgaaggaaaggctttcagtttttccctattcattatgatactagctgtgggactgccatatatggcatttattatgttaaggtatgttccttctatactcagttttttgggggtttttatcatgaagtgatgttgaattttattaaatgctttttcagcatcaaatgaaatgatcagatggtttttgttcgttattctgtagatacgatgtaccacattgattgatttgcatatgttgaacaagtcttgcatcccagggataaatacttggtcatgatgaatgatcgttttaaagtaatattactgtattcagttgctagtattttgttgaggttttttgcatcaatattcatcagatatattggcctgtagttttcttttttcaatgtgtctttggttttggtatcagggtaatacttgcctcatgtaatgagtttggcagtattctcttctatttttcagaatagtttgggtcagattggtattagttctcctttaaatatttggtagagttcacctgtgaagccattagctcccaggcttttctttactgtgagactttttattatggcttcaatctccttacttgttattggcctattcaagttttggatttctttatggttcaatcttggtaggttgtttttgtctagaaatttgctcatttcttcaagattttccagtttatcagcatgtagtttctcatagtagccactaatgatcctttgaatttctgcagtatcaagtgtaatgtgtccgtttttacctctgattttatttatttgggtcgtctttcttattttcttagtctagccaaaggtttgtcaactttaacttttcaaaatgcgaattttttgttttattgctcttttgtgttgcttcatttcaatttcatttgtctatggtcttatctttattatctcttccagtattttggttttggtttgctctcttttctagctctttaagatgcattgttaggttgtttatttgaagtttttcttcttttttgaggtaagcacatataactataaatttccctcttagtactgcttttgctatatcccataggtttttgtatgttgtgttttcattatcatttgtttcaagaaagttttcaatttccttcctaatttcttcattgatccacttgtcatttggaaatgtattgttcaattttcatgtattcgtgtagtttccaaaattcctcttgtcatcaatttctagttttattcttttgtagtcagagaagatgcttgagaggattttagtttttttgaatgttttaaggcttgttttgtaacctaacatggtctgtctttgagaatgatccatttgctgaggaaaagaatgcgtattctgcagtctttggatgaaatattctatacatgtctgttaggtccatttgttctatagtgtagataaactccaacgtttcttggttaatttctgtctggaatatctgtcaaatgctgaaagtggggtgttgaagtctccagctattattatattgggggttctctctctctttagcttcatttgatatttgctttatatatttgagttctccagtgctgtttgcatatatatttgaaattctcttgttgaattggcccctttatcattctattattttgcctctttttatagattttgtcttgaaatctatttttcctgatatgagtatagctactcctgctctttttgggtttccattggcttggaatatcttttccattcctttactttcagtctatgtgtgtctttataggtgaagtttcttataggcaacaaatcactgtgttttgttttgttttgtttttaaatttatgcagccactctatgactttttattggagagtttagtccatttgtattcagtgttactgttgataagtaaagacttcctcctgccattttgttatttgttttctggttgttttatggtctcttccttctttctttctttctgttctatcttccttttagtgaaagtgattttctctgttgaaatgatttagtttcttggtttgaggttcccatgagccttgcaaatactatcttaataaccattattttaagctgatgagaacttaacactgtttgcactaacaaacaaacaagcaaaaagaaaagtaataaaaactctatgcctcaacttcatactcccactatttaactttttgttgtttctatttagatcttattgtactgtctatgtcttgaaaagctgttgtagttattatttttgattggttcattgtttagtctttctgcttaggataaaaggaatttacacgccacaattacagtgttggtataatattctgtgttttttttgtgtggttactattgccagtaagttttttacctttagatgactagttattgctcataaatgtccttttctttctgattgaagtacttcctttagcatttcttgcaggacaggtctcatgttgaggaaattccacagcttttgtttggaaaagtctttatttctccctcatgtttgaagaatatttttgctgtttatactcttctagggtaaaagttttttccttcatcactttaaatatgtcatgccactctctgctggcctataagttttccaccgaaaactctgtcatcagatctattggagctccattgtatgttgtttgtttgtgttctcttgttgctttgaggatcctttatccttgacttttggacttgaggtagtcaaggcatttaataatccctgttaaaagactctgatgcatttttcagtatgacaattgtgtttttcagctccagtatttctgcttgattcttttaaattatttcaatctctttgttaaatttatctaatattgtctttgggttaaatctgcttgctgttctataaccttcttgtacttaggtatcgatgtatttctctaggtttgggaagttctctgttattattcctttcaataaaccttctacccctgactttttcctctacctcctgattaagggcaataactcttatatattcccttttgaggtgcctgtaggcatggttaattgttttttattcttgttttaatctcttctgactgtgcattttcaaatagccagtcttcaagctcacgaattctttgttctgcttgaccaaatctgctgttaaaagactctgatgcatttttcagtatgacaattgcatttttcagctccagtatttctgcttgattcttttagattatttcaatctctttgttaaatttatctgatagaattctgaattccttctctgtgttatcttgaaatttctttaagtttcctcaaaatagctattttgaattctctacctgaaatgtcacatatcttttgtttttccaggattggtacctggtgccttatttcgttcatttgatgaggttatgttttcctgaattgtcctaatacttgtagatgtttatctgttgctgggcattgaaaagttaggaatttattagagtttttgcagccaagacttgtttgtacccatccttcttgggaaggcattccagatattcaaaaggacttaggtgttatgatctaagctgtatctgcctcagggagcaccccaagcccggtgatgctgtgcttcttacagactcatagaggcctccttgatgatcttggacaagatctgggataattctctggattacctggcagagacttttgttctcttcccttactgtctcccaaataaacagtctctcactctgttgtgagccacctgaagctgtgggtggagtgagacaagcacccttgtggccaccaccaccatgactgtgctgggtcatacctgaagccaacacagcactacatcttgctcaagtcctgctttaacccctccctggctactgcttatgttctctcaagaccctgaggctctacagtcagcaaatgccaaagccagtgggcttgtgttcttcccttcagggcagcaatttcccccaggccctgggtgggtccagaggtgctgtctgggagccagggactagcatttaaaaccttagaagtgcacctggtgttctgttgtactgtggctgatctgacactcaaaccacaagatgtagttcttcccactcttctctcccctttccaaaggcagaggatccccaccccatggccactgtcaccacaaaaccatggtaagtagtgccaaactaccactgctgtttccttaaggcctgaggtctcttcaatcagcttgtagcgaatgctgcctggcctgggcctcacccttcaaggacagtgggctcccctctggcccagggcaggtccagaaatgccatccatccaagagccaagtcctagaattgtggaccccaagaacctgctttgttctctagccccctatgcatgagctggtacctaaggtacaagacaaagtcccctttcctttttcttctgcttttttgaagcagaaggaattgtgccccgtagtcaaccgcagctccagatgtgctgggtctcacctgaagccaacaagtctcacagtctcacacagggcccttgatttagtacttgggtatcattgctgctttttcagggcccaagggctcttcagttagctggtgatgaatggtgccaggatggggtcattcccttctggaccagggtatgtctaggaatgtcatccaggagcttgggcctggaaaggggccctcatgactctgaccagtgccctatcctgccatggctaagctagtatccaagatgcaagataaagttttccctgttttctcctcaagcggaaggaaggagtctcttttggagccatgagctgtaaagcctggggttagggaagagataataccagcactctcttggccaccctggctggtgttttagtatgttgtgtgtcacccctatccactgtctctgggccctgttcagcattagaactctcctaggatttgcagtccttgtggcctagactgtgtttcaagtttatttatttaaatcctcatagcactttagcccatggtgtccaggtttgtgggaactcaggttccaactgccaggattgatgattccgctctggctagggctggtttaaatgctccctctgtgggtgggcatcagctgagtttggtcttgttttcctttctgctctatcaggacagcagcaagttcaatgcctcacaattgctgtgctctccctccagcacaaagaaacactctagtcaccacgctaccactgcctgggcttcaggaaggtgtggcatcactgatttaagatggtttttttttttttttttttaaggttttcagtgcctttttcagtgatgcgaagttaaaactgggtactgtgagtgctcacctgatgtttggttcctatgagggtgcttttttgtgtagataattattaaattggtgtccttgcggggggctagggaaggcaattggtggagccttctgttctaccatcttgctccacctcctccaacattttctttatctacttatacatcagtggacacttgggttgcttccacctctcgcctattgtgaataatgcttttatgaacataggtgtacaactatctcttcaaatatctgctttcattttgtttgggtatgtagcctgaagtggaattgctgaattctatggtaatcttttttttattttatatttatttttttctttgttttttggagagtagttttattagcttgggatataatgggatcatcactaggagggcagggtattccactggttaccacgtgcagctgtctggggagcatgataaaattcagtccagggttctgtgctggggagcagggccttgaaaagaaggcaaattgtccagggaagtagtagctgtgagggtcatggctaccttgctccactctactgcactggatctcctggtgcttttcaggctcctgtcaatcctgcatctgtatggggcaatggaccatctggcccaaaacttcatcctcaagtttgatgtaggccaggcatttctgcttctttccactggacttgactttgcactcaggattcttcttgcagaaatttatatactggagcttaaattctagccccacaaagttccctgctggggagagtgtatccatagcactgctcatattggtctccctgaaggctcactgcataagtggatgcttatggaatttccccagggtacctgcaggccctgctgctaggcctttaggagctcagccccgcctaatcccatggtgcccagccataggtccagcaggatcagcagctactgcatgggtttccctcagtcaccctggaccttctttcctgtgccttcaagaaatttcctaaccttcaccatggctaaatcttggcctcagctgtcaatctcttcctggtcttctccccctgcacatccctgcccctgatgctctttcctactgtgggggcctgttttcacttatgtacttattttctccctggaattataaaccctgttgatagactgtaacatccttaaagtcagcaaagataaacatgtttctatcttcatgataaccagttattatttggtctacaatacaatgtaatttttttaaatgtattttcagccttgctgtaagaaacagtctaatgggaacttatagttgtgtttatcaaaagagtttattgaaggtgttgtttattacattacacaaggatttcttcccacaagaaatcctttttgctgactttagtgtcaaaaatggatgggcatgtttgaggtgatggatattccaattaccctgtttttatcattatactttgtataatgtatcagaatatcacatgtatctcataagtatatacagttattatgtatcaatttaagaaaagactggatgggcttctccgagaaactggcttgctgttatctaatgaatgttttaaactattaatgtttttcatttgtatgaattttttatattttcattattctggctcccactttatgactaaccatattttcctcatctactttgaatttgtattgccctcctgaattgtgtgtgtgtaaacaatatacttaaatgccttttgatgcaaagcataatttaaataaatatatattaaacaaagaccttaaagttttaatggaaaatagaaaaacatttttggtataatgacttttggtatggtacaaacaaacagtctagaggtttggaaaccatcctttccgttcctccctcactcctaattctgcatagtctttaagagcatggatttagaggcaaatggacttgggtttagaccttgccttaccatttataagctgttggatcccaggcatggtccctaaatttaaattttcttatctgtaaaatcaagataatgatatacagttcataaataatagaaggtattactattattcagcatcaattcttctatatagaattgatataaaactattgaaagtgtagcctttttcaaaataagttaggacagagtaaatgagaacagtcccagaagaaaattatccttccttttaaaattttatttggttttcttgagaatccttgtgaaaacaaatcatatgctacttgttatagagcgactgcttgcttgtaggaggacgactgttaaggatgcctttgaagaacataaagaacaggggtttctcaggtcaacatgtattatattggtatctaaaaactatttgcaatgtttcccctttcattcattcaaatgccacttcagattgaatgccatctgggtactctacacagtattgaattcatcaagagtatgctagcatggactttagtccttggtagttttaattttttttttctggtaggtctagaagagtgtgatttcattagccactgttgtatgttattctttttcattttaataactgtatgtttctatctctctttacccatttatttttgcaagggtatgaatccactttattgttgagatgtgttttttcagtcttgagatggtccgatatagtcgaattaggtttgattttggatcctctgggaccaggttttaattattggtttgcctgtgagttacttactgtgtacacttagagaattacctaatctcactgagctttaatttcttcacttctgaaattggtataacagcagtctctttgacacgacttggcatctttctgtttacttcccatcctcaccattatcctgtaatcttctaaaggaatattctacatgcaaggccttcactttctcatttcccagtcactgctcaatcccgtagtctgtctggcttctctttgccttattctaatactgttctggctaaaatcattgataatctcttaattctcagagtgctttagtccttatcttactagaatgctgtgttgcatttaacacttgtctgtcgtgcctttcttattattaccttgtcctctctgatccatttttgttttcattcttagatgcccctttgtctggccaaccctcaagttgtatggaccactatacctttcaccctatacagttgagggagattggttccaggaacccccacagataccaaactctgcaaatgctcatgtcccttatataaaatagtatggtatttggatataatctatgaaatcctcttgtatactttaagtcatctctaggttacaaataatacctaatacaagtactgcattccttgaggtctgtgtcttatttacccttttatctccagcgttcacagcagtgtctgacaaataattccttcatttttccccttgttcctgactttagagtcttccttttaaaatataaatcctgtttagctctgtgacactgtaattactaccaactccatttagatattcagcacatatttgtaatagtatcaatttacatgtttattttatttacaaataactcagtgaactctcacacagatccataatgttgtcttatagttattaggcagggagtccctcatcttactcacaggctataaatctacctgcatctacacccatcttctcctccttccctcctttttcaatagagatatacagttcttatccacatttaaatatcttcaagtctctaacatctttaagaaagaaaaacagactctctctctcaatcccatattctctagatatcctcttatttttctcttctcttacgtagcctgactgctttgaagactcctcaacccattcgatgctggcttattgccatcactgtgaaaacaactctcaggaatatcactagtgactttcacattgctatatccagtgagaacatttcagccctcatcagtatacacatactaatggagaatgaaagaaaaagaagattgtatagggaggctacaaagtaattctagttactttaaggaattttgagactatagtaaagacatctgtggccttatactagaccctgtcaggaatcacactgcttttaggactgactcattttctttctcaatggctacataatctctctgtttggaaacttgacttccttttgcacatcttttctaatttcatctctgttttttctattctcttataatttctgctcctccataacttcagctggaatgtagccccttatagcctctggtctccctccttgacataatgaggacctcttagtttcagctaattgccttattttcttggtattctttacttaaatttctagagcgttagttttattagtccagttcatcatttgtatcaggccacttcacaggtgattgaaaccgcctcaatctatagcctagccaatcacttatgaattgccctgggtaatcctgatttctacttttggatttgagtaaaatccaaatgataatggattaaggagcgcatcacaggtgaggaaataagggtaagggcttgaatccaaagagggtgacagactagtggggagcacacatgatcaacaaaatcaaataaaggattttgtgttttattttaagatggcagagatttgaacatagaatgagtcaataggcaatagttgaaacaaagagagaatttaattttttagttattgaagttgtgttaaggtggcagaagatgggactacagagtacagaaagatagattagctttaaataggaaggatacctcttcctctgaagtggagtttaagtaagaaagtaagaatttgatgcagataaatttgaaaataggggaacctgcctgttggcatactttatgaaatagtcagcaaggagaactgcacagaagaaagataaagatttccagtacgtgctgaggaaaattcaactaggtacctaacaactacgagtatgatgaagtgattttctttttcactgtagcccatatgtaggttaagaaagggcgaaggatttggctagttcagagttaaaatggacttaatttgtgacatggtagcattaatgcttgcttctaacccacccttcacatttatttggtttgaccatgttttcattctggtctttcatacttttattttgtaggtcttgatgactgtttgcagcagtatattaagaactttgagagggagaagatcagtggggaccagctgctgcgcattacacatcaggagctagaagatctgggggtcagccgcattggccatcaggaactgatcttggaagcagttgaccttctgtgtgcattggtaaggacataaaactggtgaagagggaaacttctctttttcttcttttgttgcttttcccttttttcttctcctcttttgataatcgaaatgcaaatagaagaaaaaaactctgattctcaaccagctggacctgatattttcttccttccttaaatttattatattagtgccaaataacagttccctgtttgtaacatcttttataacagtaagacttgggtatatcagaaccttaagtccagagtgtatgtctcataagcagggctcttcatagatgaaccactcatgtgctaggctctcacactgccagttgagaaaggaaagaatattgattgacagtgttacatacatacagtctagacgtttgaagtttgacccatgaacaaggctctgccgacctaaacctacttaaaaggatggcatcagaaatagatgtctagaccacttctaagtttgaaccatgtagctgtggtgaatcctttctgatgctgagctttaatccctgtacagttctgggtttaagcaccaggtttaagtcatgtcatttggatagttcattatgtgattgagctcttctggaagttaatgcggaaaataaatttaaacaccatttttttttctgtttattcagcaattccttagtcgcagtccccaaagaggtcaaatgttaaacttccttcttaccccttcctaatgtagtggatatacatcaacaagtcagaagtacagatgtatttcagtttatgcaacagatgctttctggggaatataaagcaaatttctgggtagtgaattctaattttcttctacataccattatgaaatcaggaggtgagattccttatcaacaagctgagttgactagtccaggaagttgtgctattgggactatatctttacctccttcccctctatccccaactactctttgaatttccgtttaccctgctaagtcttgtctctctgatctttactggcctttctacattttccttatgtctactgtattcatttctttttcaacaattacatattcatgctcaaacagtgctatcacggggaatgcaaagatgaaaaagacagtctgtactcctgaaacatatacagtccattaagaaagacaatagccatcagaagacaacatagatttaaagaaaattccaggggagtgtagaaggaaatgaacacttctgagggattcaggaagtgtaggtaagatatgcatttggtcttgcaggatgatgagatgtttgccagacaaaaagttggagaaaagttatctaggcagaagaaatatcatgtgtaaagacagaattgtgaaagaatatggaatattcagagaaaattgagaattttcatttagcttgtgcagaatgggaagtgatgggaaaaaagggaacttaacaccttgtattacaattctttgcttaggttcttttatcctttaattcatgttgggctcctcaaaggaagacatctttgtttagttcatattttttattcagctttctgcccagtgcttagctcataaaagatgctaaattaatgttatcttactgaattaaactctctgtctttcttcagagaagcataatttttctcttacctgcatagcctttgactttgaagtttctgttcctcatataaaggaagacatagaaaaattagcagattccttttgtttctttaagctatactatattttcgtctaccttgtcttgaagttattccttatgtgaataaatgtttatggcagctgatgagaatcaaaggtttatttagtcacttgtttattcatgcaacatatatttattaagcatcagatatattgtttgcatcatgttattctagaaagaagtaagctgttcatgatttggaggtgtaataatatttcaagctattaagctataatttagtatgctttaatagagagcaaagatattaactgaaagagtaaaaatgtaaataaaaatatatatatagcttaacgtatggtccttaatttgtgttctgacaatacactttttattaggaactgtaaataaatcatttatgacaggataagaacagttttcatttcatttttcatgtacttataatttcaggcattttgcatgaaagatttgatgtttgcaattgctgggatttgtttctttgcaacataattgcttggttcattcatcttaaaataatttattttccaaaaaaattcattaaagcaagccttttaggactcactcatatttataaagcaatgtattataaagctaaaaaggtgctacacgatgcattcaaattaagaactctgaataaaatggcattgacattgtaaaatctgttgttgccaatattaagtatttctagttaagtggttagtgaaaatttgccactagtgaggatatagctgaccttatttttctaaaatgttaaatacatttctttatttctttcaaatgcttttgcatgcatatgattgaaagagaaggctgatatgaacttagcataaattcattaagacttaaatggctgtgttgaatcagttctaagtcattactggttctggcacatggtaatggccaagtatatgaacaaataagtaacatatatgacaaacacagcagctaagtacatttcatgtataagtttttgttttcttgaggtagtcctttttatactaatagtaataccaagttttgctatgcatatccaataaaaagcaaatctgtggtgaataaacctgcatttttaaaaagttgaggcagtgccctccgtacccctggcctaacacaaaaggtgcttgatatacttgtcagttctttaaatggtaggtaagggtgtgtgatttactggtgacttaccatgtcacaacaaaccatccacttacatgaaagaaatagccagaaggtatctgtattggtagtaattgagaattgtaattataaaaattaacctgaggctgggcatggtggcatgcctgtaattccagcactttgggagcctgaggagggcagatcacttgagcctaggagttcaagaccagcctgggcaatgtagcaagaccacatctctacaaaaaatttaaaaattagccaggtgtgctggcatacacctgtagtaccaggtacttagaaggctgaggtggaaggatcgcttgaacccaggaagtccaggctgcagtgagctgtgataatgccactgcactccatcctgggtgacagaacgagaccctgtatcaaaaaaataaaataaaataaattttaaaaattaaaaagttaacttgagagatcaattaatctcttttgttaaaatagtagcacataaatctggttacatacagatgagcttcttacctattatactcttctaaatttttaaaacatgtttttagattatcagtgtagttatgttcattaactagagcaagttttaacaatttccttccccatcctctgctacatatcttttaaagattcttttttcctctgcatttctctgtcctctacatttttcacctctattctgcgtaatatatttttaggaggtttccaagttagaacctctgagagtatccttccaggttttgtccggatgattattatattccctaattcttgagtcatatgaaaaataataattttagtttcttaaattttgaagactctggaatatttttactttgcctttggatttttacttataagaagattaatattattttacctttcctaataaatcatttgagatgctagtgttatatagagataaacaatttaaaataatcttttatggaggctaatagctacagagtgaaatatcagttaccaagttgagtaggtttctcgctaataaattgttataatttgaacttctctaagagattactataatttgttggcaaacaaatgttttcttattaaactcatttatacacaaaaatgaaaaatacaatcattttttactttagaaaaatgctttaacacagggaaaacttctgaaaatactttgcttttcagtattttcatttacaattacatttacagaagaaatatcatttacagttagtttgtatagttataaattgttcttatctagtcattagagagcatcttttataaacataagaggatttctttcatactgtagtgaccggctggacaaactctcccacatttcacaaataatccattcttaaatgcaatagaatttgaatagaatgttgttttatttgcccaagcaaatcttttaacatgagagaagaatattacagttcaaattaagcagtgaatatttaacatattaatactatgttattttagaaaacaaatttataactttagaagaaagtgttcttttaataaatatgtaaattcccagcaaaagacaagcagacttttatcacgattaaatctgtagtggtaacatacataacttggtatttaatgtttaggcatcaaaaccttcctctcccctcattttgtctccactaagttttctcttgtcttaaattgtcataggaaaaaaagacacctaaatgttatatacaaagtaggtacccagtgattgttgacttaataacatagcttaattcattgtatggcttactttcctttttcacccttcatcttccactttgacttaattattgttaccatgtttctgagaataggagtagaatattggtgctaaggaatgtggtagacatatccgctcacagatggcctggtgacttgtagttccattctgaactctgtctagtccaagtacagagttttttaagcaaactgttaaaaaagaaatcttcccatacctcagtttccccaactgtgaaaaggtaagtcaaacttagcctcccaggcccaagcaaattcttacattctttgggttttgccattttaagtaaggtggtaataactttaactttacacacaacagtaatgtgcatgctgctaagtgttttaatcaaggttatccttggataatattaaccagcctttttaaggggtgttttacaacacacaattagctgctttacattttaattgtaacttttgaaaactttccccaaagtttgaagggatcctacaatctttttctatttgaagatagtaaaaaggcttattacacttattcatataacccgtttctgctataaagtataatagataagatatttaggatgaattaacaaatattagttgaaatgtgagaacaaagaaaagaagaaaacaaatacacttaccaaaaagtcactgtgattgcttttggtgtgcttcatatttagttgtgagctaatacagccaggacaaaaacaaaaataattttagtttcataatttgtattacaaaaaggagaaagtatattagttcccctgaggaagcagagtttttcctgataccatattataaaagaaacttcttatacatcattatgtagagtacgtatttttttatctgatttatttacctgatttatttcttgctttttcattttattattgttggttgtgtttattttcctaactttggggaagcagaattatccctagtacctacattcctgaccatgtgtattgttaatagaatatctactcaaaaataattgttgataataattaatttcacaagtaaataaacttaggttttggttttaaaaaacaaatttattatttcttacaatcttgctttcttgggtagcatagttctaagatacaatgcccttatctttccatgttcatattagtacttaacacattttattataatttctttatatgacatcttcccaaatagtcacttaactgtgggctccgctaggtcaggaatcctatcttattcatttgtaactcgaatgctaccccattgcctgtgcataataaagtattcagtaaatattttcatgaatgaataaaactgactttaaatatattctctctcttttttataattcagaattatggcttggaaacagaaaatctaaaaaccctttctcacaagttgaatgcatctgccaaaaatctgcagaattttataacaggaaggagaaggagtggccattatgatgggaggaccagccgaaaattgccaaacgactttctgacctcagttgtggatctgattggagcagccaagagtctgcttgcctggttggacaggtaaagtcttccgcatgtttcataagtatcctctcctcagacaccagtttgaatataacattattttgcattttgttgtgaaaggattggacaggcagaggagtaccaagtaataaatgtctaatgatgatttaccacaatataggggtattaaatagatattagtcttttataaaatttgatgtccaactaagtagccaatcaataattagtctgacaactgtaaaataccttgctgctttataagcaaaatcattatttggctgtcataataaaatttataaatttttgtttattataatactgctttgtgtcctgatgttctttattcatattaattggttgtacttaaggaaatgaccattgggattctataaactgttttaaataggtaattagacactgacaccttcatagcatgccttgtatgtctccttggcctcgcttcattcattctctgttattaattacattgtactattttggatatcataaacacacttttagacttttttaagtttagttgactttcatttgttttggaacacataaaatagtataaaagtcttgtaatatgaaatgaaaatgttagatttaaattatatactgtatgtggttaaacattatcatgataaaacacattacaactgtttattaaaaaactaaacaaattctctactttcagttttggaatttttggtaaggggtatgtactatgtttaatggcttaataatcaaattttaaaaatgctctttgtctttcataagaaactctgataatatacattaccagaattctttcttgaataattgtcagtaggatattcatatgtgttcctacacacacacacacacacacacacacacacacacacacacacgccagtattacattttggcattttaaaaacatgaggccttatattaaaagtaaagcttttgtatttttaaggtgaaaattgagataattttccttaattttatattgtctaattttatatatacttatacataatataaagtgatgatactaaatccaaatatgaaacactaaactatatattactagctttttgataattaattaatggactacatgtttattttgcattataacattattaaaatttaattttcataattgtctaagccacattatcaagtgtttaaattaattgaattttaaatatatacattccaaaagttatgaatggtcagtaagtaaaatatggcttagtccttaagtactattaatataatacatttgttttggtaggctttacagtaatcagaaggcttaaagaacacatccttgattataattgtatcttcttttactctcattttccctataattataaatttgctcagccttgatatctgcatttagtaaattcatttatatattttttaccctagtatttgttagatggatagataaactgttagagtgaatagaaaatgtttttacttcttgatgacagatatggctatttataaaatcgcacatttcccacactatagtagtccttgagattttatcgtatcaattttttatggtggtattactttcattatgtaataaaatgcttttggtaagtgccaaatcacctacaaaacacatatgtgcatgcacacctacaaaagcacataaaaacacacccagtgtgtcagtgcagatttgctttaatttgagggatttaaaatgaaccctgcaaatgaatactgccaagcatttgatctttaactttagtttattccttcaatatacaatactttagatgaagaataaaaattttgtcagttaaataggattaatttgatgttataagcacctgttttcatttttaaacagctataagttttatggcattacaaaatttttattacattttggagaaaacgtgtatccacagcaatatgttttgggtttattacagtttttattttatgtcacttgaaagaggagaaagaaaaagaaagaataggttaaaaaaaatctttaattttattctagatgctgaactagatgctttatacataagtatatatactctcagctcattgaattctcacagagcagatattgttatctccattttacatatgaaatgtgaaataacttgcctaaagtcattcatctagtatgaaagttatactttgaatttatttttgtctgacattgaagtcctgttattttttccttcatgttcctttatcatgctacacctcgttttgaatgctgactaattcttgaggattttgaggaagggatatggcatataaacctttatttacattttgctatttctcttcaaaagctaaataagactaccacttttctgttttgggcctcagtatctgaaattgctacatagaacttcatttatagaaaatgtttatttcactgtttatggtaaaagtttactattttctctcatttttaacattaatatttaattctaattgtttctaaaatacctttcaagattattctattttaaagggatcattgaaatatttttgataacattgcaaaacctttaaatgtttagggcgtaatagtgtgctaggaaaataatatttatgactcacaaaaactccagtttcaatggagcttccatttaaatgagatacacgttcaaagaccagctccttacatttcctaaataagataaaatctaaggttaacacaattccattttttctcctatttaaaatattgatttcagtgaaacaccagactttcccagaggaatagtctcagaggtgaatcacagttggtagctttactgtttattttcaatgcatggtttacttgtctgtttttaacctacatcctactgtttttgacacctcatatttcttgcagttttctgtggctttgccaaatcgatctatactcagaagtttacagatcactacaagtgttacgttgtacagtaacattagtaaaaatgttcaaaattattattaaacaaagtttattttgcctttcatagtaaaagtttttttccttcatttttaccagtaatacccaattctgagagtttataaaatacctttttaaggtcatcctgttttgatgggatcagtgagatctcttgatatcattgaaaaccttttacatatttaaggcataagagtttaaggtactagggaatttttgttaagatttctctgaaattttttgtcttatgtaagaaaattgttaaactaatttcttcttccatgataagaaactaaaggacaaattaattttataccaggaaaaatattacagagaccaagaaaaccacatcaaacgctaccagataatgtgatccattgtttggtcttattttctctcatgtgctcattgtttctcacttagcactaattattcaagggaagagcagtgacattagcactaccattattcacagactaccctaaggtttcagcagtgccaacctgagaaatagtaaggcattccagattttccttattaacctcttagctttccttattagtttctaatttgtttaggatttctgaatcgttaataacctttttataaatgtaatacttttgtttagatataatgtacaaagaataatttcttatagggtcttaaacttttgcaccagagagaaatataagcatcgtattatctatatgatgatttaaggagtacagtcgcttaatttttaagatttaaataggataattcctgtaacagccacttatcgatgatccaaggattttatctttttttctctttctggcatcaaaaagctttcttgctatgaatttaatttcctttaattagagttattgtgttcttcttgtaagtaccctgaactctacttgaggatttcttcagacttaagaacagtttctttatttttgtttttgtttttgtgtgtgtgtgtatgtgcatgcatgctgatcatgttcagttattctacagagatctatcgtttttactctcatagatgatcattaagtcatgactgagtgataatctttggtaacccacaaagattggagccccacctgaccttttacccttatttatatgtagatacagcccaaatcatcataccaaaccttaaaatctgctggctaagaatggctgttagtacagttgtatatgatttgcctctaagataaaaactttagggtaattctaaatcactacaaaataaaatctgttttccttggtatgtgtttagatttttcttttcattttttcttgaaatttaatcttgagtgaaaagcttgtcctacttaaaatatgaatggtcaggaaagtggaagacatgccttggaattcagtttgctataggcatttagtgatcaaatagattttttcttttctatatttgaacatcaagtgagattcttttaagtagttatggtaaaacaaaacaaaacaaaacaaacatgctgtgcatcacctcatcacttcttaatgaaattttaagattttataaacagactctgaccttttcaaacctaggaatcgaaactcttttctaatcatgccagaagcacttttgaattcttagtttaaaatgccagtttttatgcttcaatgcagcaaaaatggtctctatgtagttttttttttttttttttttgagacagtctcactctgtcgcccagcctagagtgcagtggcgtgatctcggctcactgcaacctctgctgcccaggttcaagcgattctcctgcctcagtctcctgagtagctgggattacaggcacccgtcaccatgcctagctaatttttgtatttttagaagagacggggtttcaccatcttggccaggctggtcttgaactcctgacctcgtgatccacctgcctcggcctcccaaagtaatttttttaaattaatgatattctcctagaagtgcttatatttttcattaaaaatatttttattgaggcctaatttatattctataaattaacctattttaagtatacagtttgatgggttttagtaaattttgataacacctaatacaaccacctttacaatccagtgttagaaaacttccatcaggatggatttttaacagttggtttctgcttacaactaaagaggttaattttttttaactgacaattttgattaatcacatttttttctaattcagttttttaaattcttatgtctccttttatttaagtaaattatcttgaaaaaatatactgggtttaggagtaggaatagataagttcatgaaagagagcctataatacactgtggtgtagtcatgcattgctaatgataaggattggcaattttgttgttgtgcaaacatcatagagtgtgcttacataacctagatgatacagcctactacacacctaaactatatggtatagcctgttgctcctaggctagaaacctgtacagcatgtgactgtactgaatactataggcaattgtaacagaatggtaagtatttgttccatatctaaacccagaaaaggtacagtaagaatacagtattataatcttatgggaccattgtggtatatgcggtctgttgttgaccaaaacgtcattttatgcagcacatgaccgtatatagaatcatttagaaaacaatatgttaaaaccactagaaaaagaaagggccatttaataaattgtagtggggcgcttggttaagcctttggaaaataaataatgatagagcactatctatttttcttcactaaaataaattttagatatatcagatatctaagaagaaaatataaatttacaagaaaactagaaaaaatataggcaaaaatgatttctagatgtggaaagactttctaagtatttttaaaatggaataaaatacaaaggaatgtactgttgactacataaaaaagaaaaacgtaataaagtataagacagaagacaagctgggaaaaatatttgcaacaaacagatatgaaaagcagagggttaatgtgtaatgtgtaatattcatatattaacatatgtgaatattcatattgataaaaaacaaagcccaccaaaacgtaacagatgagtatataagtaggtaaatcaaaaaagaagaaacagaaatcactggtaaaatgtgtatatcaaacaacagagctttaaagtgcatgagcaaaaactgacagaatgaaagaggaagtagacaaatccacagttgtagacttcatttcctctttctcaagaatagataaaattaaacagaaagtaagattagaagagctgagcaccaccacctaagaacaggatgttttgacatttttagagcacttcatccaacaacaggagaataaaaattcttttcaagtacccattgaacattcaccaagatagaccatatctgtatcataaaacaaaattcaacaagtttaaaagaattgaaatcagataataaaatgaaactggtaactcatacagcacacttataagtaatccaacggtcaagtctcatggaaaataaaaagtaatacattgaacagaatgaaaaaagaccaaatcataatttgtggcacacagctaaagcagtgctgaaaaggaagtgtatagcactgaatgcttatatatatcagaaatatatatattcaaaatatatcagaaatatatatagtaaatatatcagaagcactgaatgctttatatcagaaaagatctcaaatcaatcatttaagttcccatctcaagaaaatagaaaaataagaacaaaataagtacggagcaataagatcctcttaatgataagagcagaaattagcaaaattgaaaacaatagagaagtcaatcaaaatgtaaaggttaatgaacaaatattacagataacttcacatataaatttggcagctcagatgaaatggtccaattccttgagaaacggtactaaaacaacccaaaatgaaatagatactctgaataatcccataactattgaagaaagtgaatattacctagaaacgcctcagggtgtggaaaaaatctgcaggctcaaatgatttcattgttgaattttatatatttgaagaagaaacaccatttctataccatctcttccggaaaataaaggcaggaacttttcctatatcattttttgaggcaatcattatcctgatatacccctcccccccaaaaaaaaactacagaccaatatttctcaggaacttagatgttaaaaccttcaacaaaatattaccaaactaaatctaaacgtgtaaaaagaattagacacatgactaaatgagttgcttcaaacacttgaagatacatcagtatacaggtccaccatttactagttgtgtgaccttagataagtcacttaatctttctctaccttatgcttctcctctgtaaaatgagaataataatagtgcctatctcataatagttgtgaagattaaattacctgatacaggtaaagcatttagaatagtaactggcacatagtgagccctcagtaaaccttagcagttgttattactagctcttgattgtgaatattctaagtagatactgtactcagaatcttagattcttttgaaaataaactgacatgttatctttgcctaaagtattccttttttgttttagatgtagtgaagataccttgtaagaaccaaagaacttaaataattaagaactttaaaaagagagaaatttggtagaaagcaaacattatatttcctgaatttaattttcttccaatcatttctttcaaatctttccttaaaataagtcctgaatatttttatcagtatggaaatttcagaacaatttatttcatattattgataaactcattttaggctactatattttgggacttttcaaaagctgttactagtaatcacaattttccttttccctttataggtcaccatttgctgctgtgacagactattcagttacaagaaataatgtcatacaactctgcctggagttaacaacaattgtgcaacaggtattagctgacaaactttccttctgttaatttattagcaacttcatattccaacaatgggaagtatcctatgtaccaagagtttttaagatactggtttagaagtttctcaaagacaaaccattctaaagaaatgaaatgtgtagttatttattgggagactgtgcatttagctcagttagcttaccagaagatataaaaggaacctgacctgtacacacacaaacaaatgtgcctaatagcttttaacagtgatctaattacctgaactgattttccacttcaaatattatctaagccagggatccccaaaccagatgccttcagggtccagcagctaatataaatgtttaaattaagtccggtataaggcaaggagaaatggaagagacttgggtgaattgactggaacatatcccatatccaaacatatcttttagaggaaatgtaattataggcatgatatattagtgcttgtaaattatctcttaaataatctgttctttttctactgttatgtgatgatatctcttttcagtaccaagtttttctgggctctgtggtctcttgctaccagtagtagcaagaagaataaggattaataggtaaaataatgaaataaaatagttaagtgtttatttctttatggtgaaactatgggtgattttatttagactcgacttttctctattttccaaatgaatttttattttctaaaatgaatttgagttatcaaaaaacaaaaaagaatgttaagtacattgaagaaatacctctttaagtttgccaaaggaacacagcttagacaaatactgaaattatactttaaaataaattacatagcttacgaacagttaatgttcatctaatcatctaattcagccattatatacatactaatcactgcatttgattggaattgtatgaagtatctgaagacaggaattaaacttaagctgccagtaaaagaggccaatttgaataagcaaggtgtagacttttaaaaaaatctaggacatgcatttattaccaggctttcaagaaatctcttctgaacagttatgatgatgattatgctttgaaatatgctgtgcttcaaattatttttcattcagctttaattatttttattccctttgcagcaagatgagataatcaatatctaaaaataaactgtcacaaatggcttttttccccttcctaaaacaaagtggtgctactatgaagtaaaaggaaagtgcttcttgatattggccacttacatttaaaataatactaaaattagaggagaaagttaatgtcagtttcttttgaaaacctccatttgcaggaatttgtttaatctgctatatttattttacttattcccagttgtgatgggtttggatcattgtatttgaagccttttaaagagatttccgcccccctccccaacactttcctcatcacataagattggttataatgacacttttgaaaaaaaaaaagagaaactggttttaaaatcttaaatagaattctcacaaagaactgaagcttcatttagaacactgacagcaactgaatcagaacaatgagacaggtacccacacactacttgtcagcctttaaataattgccatgatgccttccttaatggatatcagcttaacctaaaattattctactgtaccatttttatgttctccacttcaaacacaaaaatgatgaattagattgccactagttaagaaataagcacaaaagtgttggtttgcaagatgaaactttggtgaagcttaaaatacatggggcaaggttgtaatcttggaagatttgagactcagccctgtttttcatgatgattccacattggacaaacgatgtcattgttttcgccatctgtaaacagaaataatcacctctacctcaaagtttttctgagaaccaaatgagatttatttaaaaatagtgaagacttagaatcaacctaaatgcccatcagtagtagactagattaagaaaatgtatatatacaccatggaatactgtgcagctataaaaaagaatgagatcatgtcctttgcagcaacacagatggagcttggaggtcattatcttaagcaaacttaacacaggaacagaaaaccaaataccatatcttctcacttataagtgggagctaaacattgagtacacgtggacacaagggaacaacaggtactggggcctactcgagggtgaagggtgggaggagggtgaggatcgaaaaactacctttcgggtactatgctcattacgtatgtgataaaatctgtacagcaaaccccatgatacccaatttacttatataacaaacctgcacatgtacccctgaacctaaaataaaagttaaaaaaagtaaaataaaataaaatagctgatgagtgtaaagtgaaaaacaaagatgaaaataatattatttacaaaaatgggtaaggaataaagagacttgataaaaggaagtaaaataggaactttgttttgaaaaataaatgtcagagatttttttctccatttggtgttagttttcatgagctgcatttacagtgaaatctgaattaggtgctgagggaaaaattcaaacatgttaaagaacattttaaatcagattttgaagtgttaaatacagagtgaaaaattcctcttaaaactcaagttttgatgatatgctttttacctgaactggtcctctctaaactgtatttattaaaaatctctgcttgcttatgggtctgttcatttctaaccttcttagatccattttacatgttcttggttatcgctggttgtctgaatagtgttaaaaacattttacagaaaactgtaaggaagaatatttacaataatccaatcctaattacgcagaaacaattagtgctgttgctttggtctttcctgtaataaatgtctttacttaagttgttattctggctttctgacagttcttttgttttactttgttccatatttacctgtcagatgtattttattttctaaacctttgttcaagtaaatggacaaatattctttaaacatcagtattaaaaatttttatttttgatggacagcctcctttaaattatgtgctttctattcacttgtgttacctttatattattttaaatacagaaaataaaagtaaataatttatgaaacatcctctaaatctgcatcttaaaataaagatataaatgagcatattgagtatatagccctttttaaatgtattcctgctcaaatgtaatataaccattttatctgttttatcttaagttgttaattgctcaaggtaaatacttgagaagataagagtttttaggacttattgaattgggatttgtgttttaactgcttagagcacaaatttgtaaatactgtttagaaagattataaaattttgttaaaatgaatagcccagaagtaatttttagtttcattaaggatttattcaaggaaatttagcctgtagatttattgattatagatattatattttacttaattacattcatgtatatgaatagtacttcatttaccttcttagttgacatttcatatcatttactttcacaatttatggcaaaatagtgtagtgggcactgacatgaagtagatccaagttcatcatcctggctttgcttttcaacaaacagtataaacttggacaaattacttcatatctctgatattatttttctttttctgtaaaagtggatccctaccattttttagattattgttgggctgttgtgaagattagaaactgatttagcccaccatctggcatatagtgggagcttaataaatggccactcgagttattttgtgtagcaaaagagcctttggaaatgctaaactcagctagtttctcgctccacagaaaatttcaaggagtgatgctctgcttacttttggtattgagtggcaatgaagaaagatctcatttctaaaatgtgatttaaaaaaaaaaaaaaggattttagtataattcagaatgttctttagattttaatgcaaatttattactgtgcttcattttctgcaagatatgttgaaacattcatgttcaaatgtaatacagaaattaattttgattacccaggaatgtatcatctctattcacatattcaagttcaagtagtaaatacacgtaaagatgtaaaatggggatataaattatgctggagtaggcaaggtacgtattctatcgttcatatggtaagtgttgaaagcatatgaaaagcctgtccagaatggtctcacagacatttaaaacacaactttaaatattacttttactatgtactcagagttagtgtttaaaccttcctgaatcagacattctgggtgacctgaaaattatattggggctcttgagattgaaactgggacatttcagaccaaaaaacaggacaagctttatatgcatttttaaaacaatatggattatattagcatactcaattaaggcaatataaaaggtgaatgttttttcacttttttcttttatttttagttgacacataattgtatatatttatggagtacagagtcatatttcagtacatgtatacagtctgtaatgatcaaatcagggtagttagcatatccgtcatctcaaatatttgtcacttctttagggtgggaacattcaaaatcctcttttccagctttttgaaaatatgcaataaattattggtaattatattcattctacagtgctatagaacactaggattttttcctcccgtctagctgtaattttgtatctattaactaatctctccctatcccctcctctctcctacccttcccaacctctaataaccacaatctactctctacttctatgagctcaatttttttagctttcgcatatgagtgaaaacatgtaatatttatctttctgtgcttgacttatttcacttaacataatatcctttagactcatccatgttgctgtgaattataggatttaattctttttatggctgaatagtattccattgtgtacatataccacgttttcttcatctattcatctgttgattaacatttaggtggattccttatcttggctgttatgaatagtgctgtagtaaacatagagatgctgatatctcttggacataccgatttcctttccattggataaatacctagtagtgggattgctggatcatatgatagttctatttttgtgaaatatacattctgttttccataatggcactacaaatttacattcataccaacagtattttttcatttcctttctgtttaaacaaataatacttttaattcagttcaattatactttatcctttaatttttcttcagccttttactttaattataaagaagcaatatcttttcaaattttccgtataatgctaatatagtaagtcagaagttagatataaaactatcagaaataatacccagataacttgaatactttttttctgaaaaaaaatgtaaaaactaaaaatatattgttttcaaaactgaaggaatgttatatatgtgcacctgtatcttctcaaaggtgtgtgtatgagaatattatcaaaatagatataaatacacatacaagaaattctcattcatgatattaaatacctaatttttggcagctgcatatttctgaaggctcagaatgaagagataagagtgatgacatcattgcatactaatacttagcaaaggactctagaagagtggggcataataacttattattcctgcagctttctgatactggcctggcttgtgagcaaaaacttaaagacttactgtgtatcatattaatatggatgctgaaatagattgttttcataggtttattcttttataaaccaaaactatattgcatgttatcagagtcgccctgccaaagcgcttttaaagatattatcaccatcaataatatcagaaggagaatagatgagggtgtactaaactcatcaattccttttagatagcaaatagtagatcctatttctcagacatcttctttcttcactgtattacattttgaaatttatgaaatgtacatacatgcaaaagaatgcatatatgtatgttatgaagaataataataaatactcatgaatctgccctctaattaaataactacagcattaccaatattgtttcagttacttttgagctcctctcccatttcatcagcttgcctcctcaaggtgtttatcattttatttgttcttaaaatagtttcagatacttctctaaatgtatcatttgattatgcttgtctttgagcttgtaacaatgctgtcactctgtttcttactgttttcaatttatgtatttctgaattcatgcatgttttcctctgtagctgtagttcattcattttcactgcatataatattgaattctgtgcattatgtgcataccccaatatgattatccattcttcttatcatggacatttgggtatatacctacatttaagtgtaattactaggagtgtaattactaggctatacagtttgcatatgctcatctttacagctgtgaatatcatgttctcaaaattttattgcttattatgtcttgtactttcattatctttctactatctgaattactgtatttgagtcctattatgcagttcacctttgaagaggcttttatagttttctcacaaagaccctaagaagaggtaacttttacctttattcctatactacatatagggatacagatgtagaaaggtgggttaggctatttttgatcctcatgagtgataaaataaacttcagaggagagtccctgatatgctaccatttgtgatatactgtgactattctttttaaagaaccaagccaacagtaatagttcatttaagaaaagatttgctgtgacagacttggaagcaggagtagtccccatgctcttctgtgtctccagtgcctggcaaataagtgtttgttgaaagaatgatgtaattatttttcccttaaaagttcaccaaaaatgattacagaaatttagaaactttaggagtttagaatcaagtaaagagctgtttcaaagcactgatgcctgaaccccatactggacccattaaattagactctttgtgatggggtttggcatcagtattatagaagtgatgcctcaagtgattcaaatacgaagccaaagttgatagcaattgtgctatactcatactttagaaggagacaaatatgaggtgggaaaaaatgcatgtaattaagaacagtgtttcccaaaggaaacactggaccatgtttccatggaccatgattcatctaaggaggcatactaaaaatgcagattctttagactttaccacaggctgaatgattgagaagtgtggatcaggaggttcaattatttataggtgataacagcccagagcctatacatttataaaggagtctggttagttttcaatttataactgtagttattagtgggttatagtccctctgtagtaaatacatatccaaaaggattaggcgtgttctatgaaacatcaaatataagttattaaataaaaagtggttattgcacacttgtaataagaaagagagaaccaatgctagaaagtggtgtggtggtagtagacaggggaaggcactaaggttagtaaaacaagaagcaataataatcattagtaatgttttaagcatttattatatcatattgtaccatacatgaattacatgacatagattttcatacctacacaagatgaaagcagcaaaccaaataaattatagttactattaggttggtgcaaaagtaatcatagtttttgccattacttttaatgcttattatgtcttgtactttcattatcttcctcctctctgaattaccatttttgtcatatgtcataatattaatattacttttaatggcaaaaaacacgaatacttttgcaccaacctaatagttataggcactgatttattaaggcatttcgcttctgctgaagaagtagtttttaacatcccagtctgcttaggttgggtcagaatgaccaccaacatcagataggtaattcaaataaaattaggccctaacacaagtaaaataatggattgaaattgtaaatgacagcggcaggttgaagaactggtcagaatcaagtaattaggacaagtgagcacaaatcaaacttataaaataagtcaaaatttatctgttaaaaccagattgggccaggcgcgttggctcatgcctgtaatcccagcactttgggaggccagggcgggcagatcacctgaggtcaggagtcaagatcagcctggccaacatggtgaaaccctgtctctactaaaattacaaaaattagccaggcatggtggttcatgcctgtaatctcagctactcagtacactgaggcaggagaatcacttgaacccaggaggcggaggttgcagcgagccgagatcacaccactgcactccagcctgggcagcagagtgagactccgtctcaaaaaaaaaaaaaaaaaaagccagattggaaaagactagatttgcaaggaggtagcagaatgtaaccttaggttgactgtgggtaacagtatgtgaggcttgacatagcaccgctaaaaaaaaacactaataacccatgaaatgaagagatacagcctggaaaattaacgaaatggttattgcattaaaatctgcattggttaggtcttcatatgcacatctgtcttatgtttcccttctattggtgcagagttgtattagtcaaggtatactagattatgctgcagtgacaaacaacctgaaaatattagtggcttttaataatgctcatatcaaatgcccatgctccatgtgcatcctgggttgctatagctttactctatgtcctattcacttcaaagcccaggctgatagagtagtctcttctagaaaattgctggtcatcatggcagaggaaaaagagaacatggtgaaccatgcattggctcttaaagcttctgcataaaaatgagacctaacacatctactcacaattcactggtcaaaacaagtcatatagccatgactgacttcaatggctcaaggaagtttacttttccctttaaaaaatggcaggtatatatttggaaatcataatacagtctgccacagcaatcaatctatgaagaattccagtataacattatactagaattttgaggacaacaatattttttatttgaatgtaacctctctctcctcaatactgaagtgtgtttgtactgtgtgtgtgtgtgtgtgtgagacacagagagaaagaggatcagtcggtattttaagtgtaatctgctggaatatgactggtaggtttcagtgggggacaataaatgaccttttggattttgtccaagcacaaaattctggttaataatcacttggtactcggcgttagtactaggaaacttaaacagatatggattctatggaatatctcttttcaaggtgtaccaaattaagcctagatttaagatagtactattacttggacaatttagtatttattaggatttttatatcttgtcatcatcaatgatctaaaactattttttgcatacgcggacataactggcgctttttcaaatactgcacacaattactgaaaagaaatgattccattttttacaagaaaatgcaatctaaatagataaaagagacaaacgtatagggcctgaggaattgtttaaactgacagtagaaattatataccataccatctctattttatgacagccaagtgaataatcttgaattaaagaattaatgttgaatttatatttttatttatgatagtatttgattttagttttgctttgcaccctttatttgagtttattacaagggaaaaaatgcctcccattgcttagaccctatagagtttcctttccttgggatatagtagatggtcattaccataagcaacttgaatatctggaagctagagagactttctattacaaagaaatgttagcctcattctatgactataaagttcttgctatcttttctgtaatacaaatcttgcagtaaaggctcaactatttttgttaaatatatcttctgagatcaagcagattgaagtttaaaaccaaactcacatacaaaatgttttaaaaactgtgaaactcagtctatttttgtataaaatagaagtgtgaagaaactaagtgtactgtactagctttgcaattagaaattttattttcaacaatatggctttatgagttgcatttttatactcatatgtaaaatcaatgtgtaatatttattacagaaagtgaaaatagagaatcagtgcaataaaatattgataacagataaattcagattatagagtgtacagagaaccttgagaaagtaaagagacattgaagttgaatatggggttccttctctgaaaatattaacaatctaatgggaaagactaagactagcaaataaataactgatgaaaacataaaatatctagaactagaaataccatttgacccagccatcccattactgggtatatatccaaaggactataaatcatgctgctataaagacacatgcacacctatgtttattgcggcactattcacaatagcaaagacttggagccaacccaaatgcctaacaatgatagactggattaagaaaatgtggcacatatacaccatggaccactatgcagccataaaaaatgatgagttcatgtcctttgtagggacatggatgaaattggaaatcatcattctcagtaaactatcgcaaggacaaaaaaccaaacaccgcatgttctcactcataggtgggaattgaacagtgagaacacgtggacacaggaaggggaacatcacactctggggactgttgtggggtggggggaggggggagggatagcattaggagatatacctaatgctaaatgacgagttaatgggtgcagcacatcagcatggcacatgtatacgtatgtaactaacctgcacattgtgcacgtgtaccctaaaacttaaagtataataataataaaataaaataaaaagaaagcataaaatatgtaaagctagtagagttatctggtagaccattcaaaaccatttaggccttgtctcatgacatgcaaaataaacaaacttagttcataatgggaattaactcactgcctcttcaggctgtcaaaacacagctattaaagttacaagacagctattaaagttacagggattacagtctcaatctaatgaatgaatgaatgaatgcatgaatttatttattttccccaagatggagtctcactctgtcacccaggctggagtgcagtggcgcaatctcggctcactgcaaccttcacctcccaggttcaagcaattctcctgcctcagcctcccaagtagctgggattacaggggtgcgccaccatgctcggctaattttttgtgtgtttttagtagagacggagtttcaccatgttgaccaggttggtctcgaactcctgacctcatgatctgcctgcgtaggcctcccaaagtagtgggattacaggcatgagccaccatgcctggcccactctaaatgaattttctaatcgttgataaccttgacatttttacttcagtcttgaaattttgatttttttggtttgttaaagacccatatgaatgctgaaaaaacaattagcctttcttttgcctgtaccctcacgtctctatatgctaaaaaattattttacacactcattcaattattggggcgttagtttttcattgtgaagtaaaagactagagtagttggagctaactttagatgaccttgtgggagagaactggaatagaattttgtagaggaatattatgcaagatgtggaagaattggccgtgttcactgacagaagaacaaagtagttctcagccattttacaagcatgacttattttattttattttattttattttattttattttattttattttattttattttattttattttgcagaccccatgtgttaaaaaaaatttaaggcttttgaactacatttctataataataataatttccctaatttttaattaatgatgtgtaaccactagtcagcaggagacaaccagtgttaccaaagtcagtttgtgcaatatatggtttctcttgccctttttgaattacccatagtggttctcaggccacactcctccagagttatctctatatactatcctggaaaatatgagtaataatatcttcatcttttattttataatttggaaaaaattaaatgacagaaagaaatggagaataatgtaagaagcagacatggaccaacacttcaaattgataaatattaagatatggtcatatttgcatcagaacttttttataaagttgtttgtatttctgctcaggccccttcctcagaggcatgcatgagcattggcatgtatccttttggttgatatttatatactttgctatacatatatgcagaaacaatatattttacttctcaattttagtcaacaatgaaacatcatggagtttaaacagaaggatgtgggattatgataggataattaaagtggttcagaagtttgatatagtagtcatatcagaccctgcttgaaactccttgatggcttgctcattagcctcaggataaaactcatattatttaacagactttcaaggcaacacattattagatttccaaagttttccctcttcagttcatctctccatatttctctttcatatctcatgcccttgttgctctgtatgcctcagccataggaccttttaagtttttaaaattttcagtctctaaagctgtattagtccattcttgcataggtttaaagagctacctgagtctgggtaatttataaagaaaagaggtttaattgactcaaagttctgcaggctgtacaggaagcatggctgggagacctcaggaaactcacaatcatggcagaaggtgaaagggaagcaggcacatcttacatggccagagaaggacaaagagagagcaagggggaggtactacatacctttcaacaaccagatctcgtgagaactcactcactatcacaagaacagcaagggggaaacacacctccatgatttaatcacatcccaccaggcacctcctccaacactggggatcacaatttgacatgagttttgggtggggacacaagtccaaaccatatccaaagcctttccacatatttgttttgcccagtacaattcttccaactttagttcctctcatccttccaacctcaatttacacatcacttcctctgggaagttcctctgatccttccaaaatatgacaccagagcccaattaagacattttagaagcctcaaatactaaaagtcatataggttatatgactgttgccctaccaccatattattcacaataaacacaatattaagtgcaatgaagtctgaaatttcggtttcctaatagtgactattttgatgattttattctttgaggtattgagtatcatgttatttgacaaaatcaagttacttgtttgcttactgcacagcagtctgttcttaacccatcatggtgcttattaaataatcttattgtttttctgcacattttactagactgtaaacaatttgacggtaggaattatgtattgttcaacatcctatccccagaacaaggacaatgcctggaacatggatattgatcaataaatatttgttaaatgaaaaaatcaatgttaacctagtttctcatggtttacaattacttattcaaaagccttgccttctctaagtttattcttagagatgagcaattccgacctaaaaggacgtgaagatcaagttattcctgtgtgtcgcactcactgtataacagagtggatcttcagatgagggaaaacatgaatataaactatgtctaaaggtacatctgtttgtataatattttacaatttatgaagtattttcaaatataccatctcatttggtctttataatacacttgggaggcagatatttttgtctaagtttcagatataaggtagcaggctgggacaggttaaatgacctgcaaagttatgtggcagtaaggcaggactagaactcaagtccacatcttttgactctaaataacctctctatatggaaacctgtggatcagtttatctatggctatagagcaatatagttctttctgtcactgaaaattcctaacctgaatgcttattcatgatgatcaaagtaaagcaatagtgcaattagaatatatcttccaactgactggtaaatcaatggattttatatttcaaaggaaaaaaagtaatcttagtatttttctctcttacatatcttctagagcctttacaaacctgagagtgtctatatactcattcttactactttctgagtttttggcatcgataatgttctaggtttttatagtgagataaaagtgttaaagtattggatttgagtctcagaaaacatgaaaatccaactatttttattttattattaaacaaacatattaatgattttatgtgacatttttgcataaagcttctacagagtcttctttctatggtttcagtatgtaaccaataagtcatttttatgtaaagatgtttgctttacccaagagattgtaaatgaaacttttatacccaaagccattctgtaatgaagattaccttatgtaacagattgaatgaaagcaagtcagaaataaatctttgtagaaaaccttattgacaaaattctccctcattcttttttaatccccttaaatcatattgccaccagagagattgatgtcagtggcatatttgatcataacactcttctgcttataccccttcaggggtacccccttagtgtacaagataaattttaagttctttcaaaatggtcaagtaccagcctatttcatcagcctcatttcacttcttcttgctttacaattcatattctagtaagaacaaactatgtttagctccctgcataaatctggttctcagccctatgcctttttaatcatgctattccccttgtcttgactattcctcagcttttatctggataactcctgtttattcctccagattctactcatgcttctctttaaaataaatgcctttctcagactgcttacctaggtggtagtctttccttccttaacaccctctactcatgtctttctttacagctactaatttatatttttccagctctattgaggtgtgattgacacattaaaattgtacatatttaagacatacaacatgatgctttgatgtatgtacacattatgaaataattaccacaaacaagctaattaacatattcatcacctcacatagtttcctgtgtatgtgtgtgtgtctctgtgaggtaagagcacttgaaatctactctcttagcaaatgtcaagcatgcaatacattattattgactactgtcaccatgctgtacattaggtctccagaactattcatcttatgactgaaagtttgtgccctttgaccattatctcctcccaccctgtccattgtaaccaccattctactctctgttactgtgagtttgacttcgttttttagatttcatatataaatgagatcacacagtatttgtctttctatgtctggcttatttcatttagcatgatgtcctcttggttcatccatgttgttgcaagtgggagaatatccttctttttaaaggaagattaatatttcattgtgtgtgtgtatgtgtgtatcacattttctgtatccattcatcttatgtagtacacttagattgtttctatatcttggctactgtgagtaatgctgcaatgggaaaccagacatcttttcaatatagtgattttatttcccttggatatatactcagaagtgggattgctggataatatagtcgttctatttttaatttttttgagaaacctccatactgttttccatagtgactgtaccaatttacgtttccaccaacagcagacaagaattctcttctctacgtttttgccattacttcttatcttttgacattttgattatagccattctaacaggagtgagatgatatctcattgtggttttgctttgcatttttctgataattagcaattttgaacattttttcatatacctaatggccatttgtatgttgtttttgggaaaatatctagtcaggtcctttgcccagtttttaatcaggttatttgtttctatttttgctgttgagttgtgtgggttccttacatattttggatattaaccccttattggatacatggtttgcaaatattttctcccattctgtaggttgccttttcattttgttgattctttcttttgctgtgcagaaactttttgggttgatgtagtcctgcttgtttatttttgcttttattgcctgtgactacaaatttatattgtactatatacacatttttgcgatttttctttcctgctaccctttgagctctttgcatcttctttccttgggaattttatttcggtatttttctacccttgtatcttttggatggtctgtgcatatttttctctagaccactaagtaaaataacatataacttggcataatctattggtaagaagtcaataatcaataaacaccatgccaagaatagaacatttcattattcttttgtagttaggtaagacgcattgatattttttgttaaacatcattgtatgatacatcatgatattgattaatgtattttagcgattcaagcacataacgcatttcaaaggtaatgataatctgtaaatgtgtgcagatacaagtataccagtgtatgtggtaggtggaaaattactacagttgtgggtatggagacactgcaagtacagaattatggaatcagggccttgttcacttggaaggaaacttaggagtcatcttaattcagctgcttttgaaatttgtgtgtggatcatgataataacagctaacatttgcatgttttgtaatttacaaaacatttccatatcacttgatgttcataggcagttcaacagagttgttattgttatgatgctcttgacaactctacaaagagaattggtttcattgtactgtgctgctattgtagatttcataatagactggaatctgctgtttgctgaaggaataagaagggatacatcttgttagtacaactgaatccctccatgttttcttccagatgtggcctttactgttatttgtttggaatttttgttaaatggcttcctgttttgtaactgttgggtggactgtagtatatttctctagacctgcactgcatctaacaccacagtaaccactagctgcatttggatattgaaatgtaaatttaaatcaattaaaattaagtaaattcgattcctcatttgcatgagccacatttcaagtgctcaataaccacgtgtttctaatggttatcaaattgaacagaatagacaaagaacatttttgttatcccagaaagttttattggacagtgctactctagaccattgctatatgtatgcatcttgatgaagttgtcatctgtcagtagttaagctgggatgctgtaaggcagaaatctgtaaaagtaatcagactgacaataagtggtaaatggatgaggattgttctagcttattactaaaaatggaatagtccctctcccctatggaaaagttgttagaaacttttttgaatgtaaaagactgtaaaatgacttaaaactagtgaaaaactgaagttttgctttcttttttaacttttaagatcagaggtacaagttaacatttgtcacatagtgtatgtgtcatgggggtttgttgtatagattatttcgtcacccgggtattaagcctagtacccattagttattttttctttttctctccctcttcccaccctccaccttccaataggccccagtttctgttattcccctctatgtgtccatgtgttctcatcatttagctcccacttaaagtaaaaacatgtggtatttggttttctgttcctgtgttagttttctttttacaaaataaattttgcttttgttgttcttcagctcattgtggccaatactatatcacagtatctttttcctctgaggaataagcagctcatgtcaacattttctactcctgacaatattcttcatcctttttttttttttttttttttgagacggaattttgctgttgtccaccaggctggagtgcagtgtcacaatctcagctcactgcaatgcccgcctcctgggttcaagtgattctcctgcctcagcctcccaagtagctgggattacaggtgtgcactaccaccacccggctactttttgtatttttggtagagacagggtttcaccatgttggccaagctggtctcgaacttctgacctcaagtgattcacccgcctcggcctcccagagtgctgggattacaggcgtgagccaccaagccaggctatccttaagcttcaccagatttgtgcctccttgcccctggttgataaatttgccacatttgttatactgttttaagaagatggaaagtattagatatattcttgattcatttatttttccctttaatatcacacttcagtcagctagtctcctttcttcatatttgtcatgtcaactcctccaatgatgcgttctgcttggtgtgtatatagtactagatcttccatctcctaatacactctcccaacaaaaatgacaagaatcatgttatatagagcatacttatatattctttgcatttataatctttacatcagctgagttatataaatatgtttatctggatttttgtaaattactgtatcatgataaatgctaaactgcctatcttctttttttcatcactttgaccctgcttctcaaaaaactatgcttatagttcctttcctactttgaaatatttcttagaagaccagtttatataagtactcttacttgtacatctaaactcctcacattgtctttttcaactactccatctccattattaaattaaaactgatttttaaagcttcttgctgtcatttttctctgactcttacttaaattagacactgtttttcccttctccctttccaaaactcttttcttgtctctgtaatatcactttcttcatttaatcctggccatgggattaattcttgctctggctcctaaacaagcattgtctgaggttttatcctcagccgtcttcccaccatacatactctgttctggtgaagtcatcattgttgttttcttgtagctttaactatcccttcaatgtcagtatcttcaagatctggctctgtttccattctaattcagttttatcaaatgcttgccagacaattgtatgtaacacgttctgttttcagccgcttctaattttatgtgcacaaaataaaattgttttaatctcctcgatttcctttctccatctctactataccattcatccatccatttcctcaggcttgaacacttagagtaatgtttaacttttccttctccattatttcttgtttattaatttgcatatttcaaattttttgtggatacgtagtaagcatatatattatggaatacatgagatgtttgatgcaggcatgcaatgtattcataatcacatcatggaaaatgaggtatgcatcccctcaagaatttatctttcatgctataatccaattatactttttaagttatttttaagtgtacaattaaattattattgactatagtcacactgttgtgctatcaaatactagatcttattaattgtttctaactgtatattttttgtacccatccccacttctcctccacccccactgctatatttcccagcctctggtaaccatctttctactctctatcttcataggctcaattattttgatttttagatcctgcaaatgagtgagaacctgcagtgcttgtctttaggtgcctggcctgtttcacttaacataatgatctctagatccatagatgctgttgcaaatgactgaatctcatttttaatggctgaatagtactccattgtactacattttctttatccatttatctgttggtagacacaggttgcttcaaaatcttggctattgtgaacagagctgcaaaaaacatgaaagtgcagatatctttttaatatcctgatttcctttccttgggtatatacccagaagttggattgctggattatgtcacagctgtatttttagttttttaaggaacctccaaactgtactccatcgtgattgtactaatatacattcccaccaacagcgtacaaggttcccttttctccacatcctcaccagcatttgttattgtctgtcttttggatataagccattttaactggggtgagatgctatgtcattttagttttgctttacatttttttgatgatcaatgatgttgaatacctttgcatatgcctgatggccatttgtatgtcttcttttgaaaactgtctattcaaatcttttgcccattttttaatcagattattagatttttttttctatagcattgtttgagctccttacagattctggttattaattgcttgtcagatgggtagtttgcaaatattttctcccatgttgtggcttgtctcttcactttgttgattgtttcctttgctgtacagaagctttttaacttgatgtgatcccatttgtccatttttgctttggttgcatgtgattgtggggtaatactcaagaaatctttcccaagaccaatgtcatggagagtttccacaatgtttcctggcagtagtttcataggttgaggtcttagatttaagtctttaatccatttttatttgaattttgtatatggcgggagatacaggtctagtttcattctaatgcccatggatatccagttttcccagcaccatttattagagagactgtactttctgcagtgtatatccttggcacctttgttgaaaatgagttcactgtaggtgtgtggatttgtttctgggttgtctgctctgtttttactggactctgtgtctgtttttatgccagtaccatgctgttttaaatactctatctcagtagtataatttcaagtcaggtgttgtgattcctccagttgtgttctttttgcttaggatagctttggctattcttttgtggttccgtatacattttaggattttttttctattttttctatttctgtgaagaatgtcattggtattttgatagggattgcattgaatctgtagattgcttaggtagtgtggacattttcagaatattgattaatccaagaacaagcaatatcttttcattttttggtggcttcttccatttcttttatcagtgttttgtagtttccattacagagatctttcacttctttgattatgttaatttctagatatttaattttatttgtggctattgaaaatgggattatttttgttttctttttcaaatttttcaccgttggtatgtagaaatgctactgatttttgtatgttgattttatatcctgtatgtttgactaaacttgatcatcaattctaatagttttttcttggagtctttagatttttcccaatttaagatcattatcatctgcaagcagtggtaatttgacttcttccttcccaatttggatacactttatttatttctgttgcctaattgctctggctaggacttccagtactatgttgaatagcagtggtgaaagtgggcatccttgtgttctagatcatagaagaaaggctttcagttcttcccgattatgatattagctgtgagtctatcatacatggcttttattatgttgaggtatctttcttctatacccagtatttttttttttttttttgagacagactctcactctgtcgcccaggttggagtacggtgacgtgatctcagctcactgcaacctctgcctcctgggttcaagtgattctcctgcctcaccctcccaagtagctgggactacaggggcgtgccaccacacccggctaattttttagtagagatggggtttcactggtgttagccaggatggtctcgatctcctgaccttgtgatccgcccgcctcggcctcccaaagtgctgagattacaggcatgagccaccgagtccggctctatacccagtcttttgagggtttttattatgaagggatgttgaattgtatcaaattctttttcagcatcaattgaaatgatcctttgatttttgcccatcattcttttggtatgatgtatcacactgactgatttttgtatgttgaaccatccttgcaacccaggaataaatgacacttggtcatgatgaatgaccttattaatatattgtggaatttggtttgctagtattttgttgaggatttttacatcagtattcatcagatattggcctgtagttttctttctttggtgtgtctttgtctggttttggtaccagggtaatattggccttgtagaataagtttgagtgctccctcccctgccccctctattttttggcatagattgagtaggattggtatttgttctttaatgtttggtagaattcagcagtgaagccattatgtccccagctttcctttttgggagactttttattatggcttcgatctcattgcttgttattggcctcctcaggttttagatttcttcatggttaaattttggcaggttgtgtgtgtctaggaatttatctatgattttccaatttattgccatggatggatatcgctgctgctagttattcagggcccaagagcttttcagttagcaggtgatgcatgctacctggactgggtccttccccttaaggcaacaggttcccttttgacccagagtgcatctagaaatgtctatcaggagctagggcctggaaagggggcctgaggactctgactggtaccctatcctgctgtggctgagctggtatcccaagacgcaaacaaagtcttccccactcttccatttcctctccccaagtgaaaggaaggggccttctttggagccacgagctatgcaacctggggttaggggagggttgatgccggtgctcccttagccatcccagctggtatctcagtaagttgtgtgccgcccccctagtccactgtctctgggcccagcttagcactaggacttgcctaagagttgctgtccttgtggcctagacggcttttgcagtttatttggggccccacatcgctgtagcccatggtggcgaagcttgtggaaactcaagttcagatggctgggattggtgattgattcccctctggttaggactcgtttaaatgctccctccatgggtgaacatcagctgaatttggttcagttttgttttctgctataacaacgtcagagctgagtttaatgcctcagaattactggctttctttctccccagtgcacagaaacactctcatcatcaggcagctgctgcccaggtttgggggaaagggggcattggcaattgaagactgtttttcctacctcttctgtgcctctttcaatgatatgaagttaaaactaggtattgtgagtactcacctgatttttggttcttatggagatgtttttttctgtggagatagttgttaaatcggctggggggacaatccctcctccaccctttctagagataaaacatccactttagtatgtctaggaagatacacaactttgcggagattcccataactgagatatggcacaaaaattactcttaaggggctatgaagaatggaacaagagatgactatgggagttgttagctggacaagaacatttcatctctacagacccctcaaccctcactcacaactcacattgctgtatatcatcaactattatattagataggctgccttgacttcaactcttccccaaggaaagtcaagagaaattataaactgactgagttaagtttttgaaagagattcaaaatggaaattaaattgttatagaaaaattgaaattgcttttcttttaaaacaaaaacaaaaattttcttcaacctaacattggtagctctccataatatgccccatattattttctctgccttctttcccactgcattttccccacatagcttaaattttaaccaaatcagtctgcttacttcttattgactgtgcatttgttcagtgtgttcacacactttgaaatgttctttctccctaaaccttcaaattccagatttgaaagccatttagggccaggtaaaatatcatttccttcacttagttaatccaggattatcagaatttatctcctttttaatgggatcttttgttagaatttatcttatctaccttctatttgtatttgaatgttttctcccctcctacttaatgaaattgtgatggccaaataccaagggtaatttatccctcattacataatagtatctggaactgaattgcatttagatgacaaaaaacatgttggtgaactgaattgtgacttcaataaataaatgaatgcaaggaagagaggaaggcagggagggaggagaaaaaaaaggaaaggaaaagtataatattcattgcttaaattaaccccttaggcatgtaaagacattttgataataatagaatatgttgaagtgttgagtatgaaggtaccattatcaaaggtttacatagatggattatttatatattacttctaagtaaaacaatatttttatattatttgtaaaagtatacaatatatacacaaaaataagacatatggaaatttatggcatttataaagttccatgaaatataatagtattattattagagatatacactatttcccttcactatctctctttatatatttactattaataacatatgcactgttcttatgattataatatacaattgatgagaaatattacttgttctgagcattgtgacccaccaggcgcttaaaacttgttgacaaagtatggagcatcagtggtaatatgtaggagtaaaaattgttctgttattctgctcagtatagcaattgcatcattgtttcacagaaaggataacattatgatcctgtgtgggtgtatagctcatctgtgggaggatgtttctgtgcatacttagtgatcaaaattcaagaaacacgcctcatttttatgaatattttctcattaggaatttggctcatgtaaatgcatcacataatttgtagaagcattatatggaaaaggaaaaagaagaaatgaattttttttgcatatacaataaaagcttgagctactgaagagaattcctggtagtatatagtatcgtgactggaaacccagtctttaaaaactaaatttaattctaacctaaaaataactggaatgtcagaggtgtacctttccacagcatgaataggtttgtaaagtatagatttatccatatgcaatgctattttctctttaaaacttgagatatcttttgggaaaggatttggccccaagtattaataaaacccatactttagaagcaagtattttaaaatcacctgttgatggaagtaaaataacttagtaataaataaacccccccaaagtacctagagctatttaaatacttaacatgatgaaatgaatgccataaaattacagcttaacaaaatataacatagtcatttagtttctattcttctccctaatataaagtagcaggttaatatgcattctctctgtttggttttgttgttcttttttttgttttgaggcagagtctcactctgtcacccaggctggagtgcagtggtgcaatcttggctcactgcaacctctacctcccagattcaagcgattctcctacctcagccttccgagtagctgggattacaggcatgtgccaccacacccagctaatttttgtatttttagtagagacggggtttcaccatgttggccaggctggtcttgaactcctgtcctcaagcgatccgcccacctaggcctcccaaagtgctaggattataggcatgaaccactgtgcctggcttctatttttaatatgctgcatcctcaccctttgtggaaagcctctgggtttcaataactagcaagccgatcttgctgaaagaaggtagagatacaaacaagtagaagcaactgttccacataaagaaagaaataagtttaatgggaaaaaataatgaattgggggaacgtgcaatcaaaatacaattctgaggatctcagaactatttggagtgagctggcagataatgttataaaaagcaggttaccagtttatggattctatatatttgataattttgggatagctttggtgttcctgtatcacatggtaatcctataaaatagatcaagtgtttctcgaaataccatctttataaatatcatcttggaggcctcactctgaatcaactagatccgtacttctgggaatctgcattttaacccacccctcaaatgattcttatatatgcagaagtaaaatctgaaaattactatagtagcttaactgagtgtggttacattgcttttgtgatgatgccattattttctctttctaaagacccactgtttccaagacccagttaaaagccacctttcttgatttgttttaacacagagtttagtttcttcctcctctgctcctctagctcccataattgtgcctttgttacactaatcaagagtatcccaaatctcttaatgcagatttaaactttaataactttacatacgtaagtgctacaaccttaccaaaaacattatttaaaatttatttaaatttattttacaatcatttagttttgtttattttaaatagtaagttcttaattttaatatttatatgtggcatttttttggactggtagaaaaacttgaccacctcaatcacctcatatatctcccttaaactttcttttgcagggtcatgtcaaaatagttgagtgtgcaccaatattttattcttcaaataatcttaaatctaggatcacagatgtcatcctttctgtcactaacccacagctggtagaagtttttgaaaagtttgaaatttgactagagcaatgtatagtacaacccagtatactatatgttgaattttatttcctgttgaatgttaataaaaatatattaatatcttaaaattttaaataattggccttttatctattgatttgtgtaatggtgtatcatttatacttctaaagttaaaaatacttaaaacagcatgaatactttgaaattctgtgttttaacttatttgtgtgaattcctatctccctaaacagcacttctctaagtcaggggccatgttttattcatccttttgtctctagtacagttgattaatatttgctgaatcaaggggaaaaatatgtctattttatattgtctaattaatttagtatattcaatattatttaaatattactaactatatttagatataggtagcacatttaaaatgtaatattaatatagcatcaaacatatatttaatagtatttgttgtgtttccatccattgcagttattatccttttagatgctcaaattgttccatgtttgactagggggaatctcttcatgttgagtcctgagtcctactaaaacaggagccaactcctgtgtagtggtagtcttgacagattactcctagtagtctttgataacttccttctgtcttgtatcacagtataatccaagctcatcttgtacgtttcctattccagatctcaaatcagccattttccaagaaggcttggaaatgtggttttaagaccataaagtctgggaagtgtatcattactaggttggtcattgttcctatgccttttcagggtgcagtgctaataaatacatgcatacatgtatatacatatgtacatagataatacttcaagagactccagcatattatttaacttcttcaatcttatatatgtgtctgctttatcccatgctaaaaatacttatcaatgacactggagtgatagaatggcagtcacataattgttcagttattcatcttataaagcacacacagcagattctgcatgacaataataatcacaacactaccatctaacatcatatgattactgaaaacagtttaagattattttaacagttctttttgttggatcacattaggaatgtgctagtaaatttttatattttaaagatacttgaaatagttactttccgtatgattattatccactactagagtatacattcagatcatgtttactttgtttacttttttccttgaggagaatccctttgaagtttgaatttttagtcataccctctgattctgggaaggtaggcaaataatggaatttgcatacattgcagctgaagcaagctgtagaagcagcatgtggaagctgggcaagttcccaacttttcccagattatctctcctttggcatatgagtccctcagaaagacaagacccaattcttaagtatttctgtgaattttgtaaaatatacttaagttttatttttaaaactttgccccgatctgcatatgtatttcttctgacaaggcattgtggtgaagttgcattatcaaaaattgtgttgaacaacattccttttttgttaaaattaaattcaggaaaaaatgaaatggagtatcatttcttaaaatattcagtactgtggaaatgggtttgttttttttttcaaaattatccaaataataattaattttattttttgaagtaaagttagttttttaaagttaaaatagcaatggccaggcgcagtggctcacgcctgtaatcccagcactttgatctgccgaggcgggcagatcatctgaggttgggagtttgagaccagcctgaccaacatggagaaaccccatctctactaaaaatatgaaaaattagccgggcatggtggcacatgcctgtaatcccagctactagggaggctgaggcaggagaatcacttgaacccagggggtggaggttgcagtgagccgagatcacaccactgcactccagcctgggcaacaagagcaaaactgtctcaaaaaaagtaaataaataaaatagtgacattaatacatggttaaaatgtatttatcacttaatgtatgtcagattctaatgacttatctcattttgtcacttaattctcacagcatttttattgggttgctaccagtatgcccgttttataaattttgtgaggaaactgcgccatagaaacattgtctctaagcaaagatcagtttgttgtattactgcttattgtatatcaagtaattgcaggttaaaagaaaagaccatggtggtttttgaaagaattttttgtaatttctgggacttaaatttaggtgagaactatgaacttggtaattattattagtagatgtattaattttaagtgtgtactgtaaagtatatttaatagcttgcaatagttgaaaatataaaagtatttgagattttgataggactattgaaataaatgttagtgtgttttttaatgttctaatctataataaattagtatttgaaatgttagggacatttcaacagaatacatttatcacgtgtaaaagcttagatagaaaatggttacaatattttttcaatatttgtttttaaaagtctacttaatgtatattgtcctttagtatgtgtttaaaagaagtaaagttagaatatacagttaagcaaaaataaggatagcctctgttactgaccatcagagctaaccattattaatattttggtatgtagcatcctagatttttcctgttattattgcttttacttgaattgttaagacttttaaaattatagtataatttctaagaaaatatttttaaaagaatgcttgatattttgaatctaatgtatatggttcttttttttcaggattgtactgtatatgaaacagagaataaaattcttcacgtggtgagtatacttggatttattttaatctttattagaggatatttccttgttcaactagaagaggtgaaccataagaaaaaaaatctactgaccacatcagttaagtgtatttttataggaaatctacaaaacaatcaaagcataacaagttacgttagttataaccattctattgtacctaataggagaaaaaaggtataatattttaaaattgtaatgtgtagcaaggttggaatataataaaaaattaataatgtagagcaaggagaatttgaaatgagaatttcttttactgttcatctattacaaaaaagatcagagaaaggtattctgttctataatgggtaattcatctctatcatcatttggatgaaatactttattaaaaaaatcaaatttcctttgctccaattctatacctacgagacaacctttcaaatggtaatatggcaatatttttgaatcagttaatgactttacatatattttattactagaaatgggctacgcgtacattatactttgtggaaaggccatctcctgccttcttaatgaacagttggccacttttatttgtaaatgcatttcttgatcaatgctagtttgtcctaataacttcttcacctctggtgtgtgtgaaatcatgtcatttctgcatctgccaggtactaggcggtgaagatccatatgtctgtaaaaggacatttgcctcatttattcctaatatcagtctattaagttttatgtttctgaaatgtttgaatatttataaaagaatactattttgtatttagaaaaggaaatacttttaaaacatctaaacgtatggagggaaaatattacttcagaatatcagcagtacagcatccctattccttttttgttatctgttatagaaatgatactgaataatcctctgctaatcctctccccctcattgtgcagtagtgatgccctttgtggtttataagaatagtctcaggagtggataattaatttacttttctccttattagtccaggagggaaaataattacaactccctcacgttgatctacctgtagggcctggagaatagaaagacactaatatttatttagggcctatatatttcaagtattagcttaatttcttataagcatattctctcatttaatcctacttttgcagatggtggaactaagggtcacaaatattaagttgttcaactattcggtttgaacacagaatctaataccaaagcccatgccctttccagatctggcagttgctaccaattctagctccctgaggctttacaaattgtactatcttttttcccgtggaacccagggctactgtctagctgtgcctattttgtcaataactaaggagcatgcacagaccctttcccacctacattttattttctgtgagtgactgtttctttagcattgaattttctatgacaatgactgttctttctgaagtattgaatttactgaattcgactttggtatgctgctgtgggttcttcattgtgtttacttcaaggctgttattgaggtcagtgtgtgttaacatttttttctttatcaagtttctcaggagtaatctccctgatgttagtatcaaaaagagctgtacttttcttcatgcattggctgctacgaacttaagattaaaatttgtggcccataattgacaagtgcatctcatggtatttgttttgtatttagcttcattcttggctctacatgatttctttttgccttgtttttctcaatttatgtatggtatatatttttacatctgttgatgtagccttttctatggaggaatagttccagttacaaatgcacatttgtgatcaatattcaaatatcaacaaaggaaatgtaaataatttatggaaaaagaatctctagagaactgtaaaaaatatgaaattttatttctgaggaaatttcagattctaccatatgacagaataacagaaatagatttaaatgatgaaagaaatactgtgggatttctcttgtacaaaagactttaaatataattttaattaattagactaaggaaataatctctttggggttataaaatgatgaatgaaattttattaaataaaaaccataataagtaatagccaaattttaaaagttcttaatcactaaatatttttaattttaaataattttaaaataataagtaatttttagtttcttaaataaattcctaataattgactcatattgactttatctttctcaaaagccagattctgggctacttgctattagaaataagtaacagcataaatagtactgaaggagtttagaaatgaatgccgtatatttaccttggcaattttgcattccagctagtgagaatttaaaaatcctgtctgatgatgatgacaacagtgaatggcattaaccaaatcagttcatctcagaaagcacttgtcttttcatgttattcttctacttcccatcctgacgtttttatacaaagattacccagcctttaccaaaaggttgtatgtatacttgtatattacttttttcacaagaataattttttagaataataaaatagtatacagtaccacttagtatatgaggctagaatagtttctttaaaacaaaatttctagaataagtatctttctagatctctatagtgtagaagaaataactttgagtctaaaaaactgtctgaatcctaattctaccattttctatctcggtgagctgaatcaagtgatgtttttgagagtttgttcttattatgtaaaatggggatattaatatctttcatgaatgattgttgctaggataaaataaatcagtaagttttctagacagagctttataatctggtagttctctttccagtatttattttttaggttatatctcattatttaggttttttgttgttgttggtttggtttttttttttttttttttgagacagagtctcgctctgtcacccaggctggagtacagtagtgcgatcttggctcactgcaagctccatctcccgggttcacgccattcccctgcctcagcctcccgagtagctgggactacaggtgcccaccaccacgcccggctaattttttttgtattttttagtagagacggggtttcaccgtgttagccaggatggtctcaatctcctgacctcgtgatccacccacctcggcctcccaaagtgctgggattacaggagtgagccactgtgcctggcctatttagggtttttaatatcttctttctctcctttttatatggaccagtaaatcaaaagccagagtttttatatagcttgtttaggatgcaattgtgagttagttttaatgttttccttgtttctatgatacttgaatattctaagtacaatatgatttataatggctccttttcaaagatgaattaatatgtattgtatatgagcatcttagcctgggttctttctggaaaacagagcctacaacaaggctcgaatgcagatagtttgtgttgattagttatcccaagactcagaagagacactgggaaggagaatcaatatgggttctagaattgttcaccactatagggaactgaagttcgatcccatcgggaccttctgagaagccctgcagaatttgccttggaattgtccaacctgcctgacaaaaactgaagagggagaatgtatctgctggctctaatccaattatcccattggtcaaagcttgctccttggggtgttaactctctcacactaccaggtttttggaggtaccagagagctctaggacagaaagcaaaggtagtgcaactgaagtgaagcagattgccacagcagtagctggagaaaaaagtgggctgagtgggtatgagatggggcttaaggggtgtctggtataatgaaacgcctctaagtggcaatccaaattttaaagtattttggatcacataaagtatcctgatagtgactgaaatcaagatttgcataactcacaaaagcaagcttcaaacagtagacataacataacttttgtgtaaaaaagcagtgtatttatagtgaagaaaataatttcaagaactatgcaacagacttaatgttggttgtctttgcaaggaataggataaattttagaggcattaactttaaattatgtgtttgtataatggttaaatatagcataacaaatatgtgttaatcagaaaaaagtagtactaaaatatccatagaaatgcctgaatagcaacccaaaatctagattaaaaatgagtattttattgttagatacaatgaattagatctactacttgatagcacaacagagtgactacagtcagcaataatttgttgtacattttagagtaactgacggagtattactggaatgttcataacacaaagaaatgataaatgcttgaagtgatggatacccccatttaccctgatgtaattattcacattgtatgcctgtatccaaatatctaatgtactccataaatacctaatgtatacctactatgtactcaaattttttctaaaaaataagtatttttaacaaatgagtaagagtttcaaatgggtaaggagtgaaaacagtgccagtagccaaccattgactaacctaaagaacatggctgaaatctttctaatgccaggcagatttagaatcctatgtaatatattaatagttcttaggaaccttttcactttagtacactggactgtgagttaaataggtttttagaacatccccagtgatggctgccatttagaaggaacaaggagaccccagatgactgaatagagattatagtagcttgagataggcgctagaacatcaactgtcttagcctaaaccctacccctaaatctttattttgtccagaggatagggaaggcagttttcaagaggaaggagaacttatcacttatgaaaacttgttatagcctaggaattccacaaggcaatacaggttgattgtcccttatctgaaatgcttgagattagaagtgtctcggatttcggatttttttggatttgggaatatttgcatgatatacttaacagttgtcactaatctgaaaatactaaaccaaaatgctccaatgagtgtttcctttgagcatcatgtcagtgctcaaaaagtttctgattttcggattagagatactcaacctgtacgagtgtcagagtgcccttcaacacatgggcaaactgagagagctgaggttgtgaggtggtgtatctttccctgaaatagatctgtatttaaggatgggtaaagaaaaagaatgggtaagaggagaggaagtatcctctaatatattagaagaaaatccttccacatgaagtaggtttattatgaacacttgtttaatgttttcagttgagccaaaagatattacctgtattaaaaaagaataccatactataaagaaggtaaggtcactataaactgagagcaaagtgaactaagaaaatagtacattaaactaacatggaagcagaaaataaaccatggagaaagcatgtatcttcccaatttttttcaattaatttgcatttctttcataatgaaaaagtataaaagtatgtatttattatagtatagttagaattctgattgcttataatggatgattttatagtacatatattgaactagtcagaagggacttggacaatcctcaggctacattttctgttcacttttctcacctctaaaattggagagagtctttctgcttaaaatcagaaagaagtaggctgtgaggaccaaaatccctggtgggaagggagattggttgcagtgttgggcagggatgtctgttaatatgaagtgtgagaatgaataaaaggagactgaacatcttgggtttcctttgaatttgccattaagtataatggaacagacaatagaatacaaccataaaggacaaaaggcaatacagataatcaatatagtatatatctcagtgattatcgactaaagataaataatattatgtttcacttctattgatctgatcttttccttccagttagtttttgttctggattacacattctctggcaggttagagcccatctgttttgctctgtgcagatccttgttttatataacaaatgagttacagagaatctggaattttcagttctatactctacttactcctcactcctgcctttcagtacacccattgagtctggagtgataagctctcctgagaagtcatttcagagcttgtgctttagcagacttcctctgcttgtccctgccctgccattctcattggtgagcctggaacacttgtcggctttgattaaactcatggaaatcccaggccaggcgtaatcattaaggtcacattgtttaaatcagattgttctgagctcacaaacaccttttacattagccaaaggtatggccttgtatatggcactttgtattttagcattttaccccattgcttttgtaaagataataaatactgcaaatgcctattttattattttagtgttaatattatcttctagttatatagtactttacagtttacagaacattctcaggaatgctttcttctcttttttctctttttttttctccaagctatttttttcttttgttacttaggtttgatcatgaattaggcttattttggcatgttaagtatttgttttatttcataaacattctttgtaattttttcctttctttaaatttatgaattccttgcccttaaactccatctggagtgagattattatgtcttctctggtatccagactagaaatagcttaaactgcatagagccaacagttagatgtaagagaggatcctggaggagaaagtaaagggctcattttagtcttttccctgacatctacatcatatcatttatgaaagtatagctttcctcttctgatggatcaaaaccttgaggatgtgtttaagtactggtgtagcagcataccccaaagtgaaataaaagtgatcatattaatgttaatagcttatctttagagatttcttgaaaacaatggtactctagtgacttaaaaatccctgaagataattttaactcgtcttcaggaggtttctgatgctgtgatgaagcagcttttgccagttgtagcccagactcttctaaaagctatgatcttgatccaaatgcaaactgaattttttttcagtatggttgagattttgttggtaactgtagcatttgaacatataaattatggtcagtctcactaaaacatcaactctaatactgagttttatagatgaaaaacgtaagatgcttctttatgttttcgaagttaaggtcacccttctgtctcagccccctttattatctttgtggtcagcctgaagaaatgtgctaacaatattgctgaaataggcgttggattctttggtgtcatattatattattttcagattttgacactttggtggttaattgcattgtaaattattttaactataaattctccacaactgatgcctcatgcaggaaaggaaaaatgagaaatccagatataacatgatagaggtggaaaatgtttgtctttcctgggacaaaaagaaaatgtgtgtggcctatgtgaagaattaaaataatctggttttagtgtttctgattatgatttaggtagacattttataaggcagtatatttatttatataggtgtttttgctaacattacatttgctgaacacattatgcattgcaagatgcttccatattcatactgactctgaaagtacaattcttgtcctcacagtagtattcatttttgttggggagtcaagtgaggtagaataatacagtagaaagagcagcaatctgagagttaaaaggataggtgtcctgaccccattctggcatttactagctgtaaagaagctaagttagcctttctgactaagttgagggcttggagtatctgtgacttttaaggtctaaatgccataattcttagatgacaaattcacaagatcattagaaagcagtatggccacataaagcgataaattgaagaactgtctttatttgagaccactgtatatatgaccaaggacactatatatttttaaaaataaagttagcaggcacatattcagttttgatacatgggcatattgcatagtggtgaagtctgggcttttagtgtagccatcacctgaatggcgtacattgtaaccattaagtcatttcttaccccttaccccctcctaccgttccactcttctaagtccccagtgtttatcatttcacattctatgtccacatgtatacactttttttaagctctcacttatacgtgagaacatgtggtatttgactttctgtttctgagttatttcacttaagataatggcctccagttccatccatgttgctgcagaagacatgattttatacttcttatggctcagtagtattccatggtgtgtgtatacacacacacacacagagacatatatgtacacacatatatatcacattttaatccagtctgttgatggacacttaacttatttagttccttatctttgctattgtgaattttgatataatatttgttttcctttgggtagatacccagtagtgagatagctggatcaatgctatatatttttttaaagtgcaattatagtcactgtcaatgtaaagatttcttccacaaggtaattgaatcagtctggaaacagaagccacacagtaacttaaaggaagtttgatataaataattataaattatgataagaaatacctgcaaacaggtaaagagcgccctaaaccatgtcctacaactgaggaatagtacccaaggaaggatatcttttaagtggaacacccttcccaaggctgagaaggtgtggctgcagcttcattgggttgcatagatcagagcttatccacagttgccaggcaagtggaagacaaccttcgaggatgtaggcaaatgatgctgctgggaaggttcacagcaagagttaggatgatgctgtgagtaagaggtctggagagcatgctgagatagcctcaggatggtgatcactgagcccaggctgaggctgcaatgtcactgtgggactgcatgatctggacatgtggctggggcacagcactaccgatatccccacacacatgcactgctagtggaccctgcaacaggaacaagaaaaaaataaaagaatgcccatgggaacctagaagccttcttctccttgcagtgtccctccactgccctctattgacaaaaacttaacattgtgcttactgtacaagataaatgcttagagtccaatccattgtcacagagcaagcactgaaggatgaattgagctgagagccacaaaactcataactgacacagtgtggttagctcttacctccataaaactacatatagctacttcacatttcttgactataagtgaagacatcgctcccaggtctctgccgtttggtccctatttatccataaagtgtatatatatagtgccttaaatttccagaagcttatctaattataatgaactgcttcactcttgctatttgaatataaaatccaagctaaaatcaaaacatttttctaataacctacatcttagttgagctatcaatatgtccagtctgttctttttcttgagcctgaaagtcatgtgtcctctaatgagtgatctctcatcttcttcggaacctgccacaagcctgcttgtctctgtttcctgcctatgaaacagcagataaatagaattgagattttcccagatccaattctggtttccagcttactctatttccctatcagaagtgagagtagtggtggagcctcttgtcccaactcttaattcataccagattgtttcaggtaagtagctgaaagtaggctcgaagtgtcatgggtgaacttcttactcatcaaaggtgtacatttgggactgacattttctcactgttttggcattgaccttatcattcttagatgattattatcttaaagtgtaatttttaggctgtattattatctcaatgttgggctcactaggcattaaaatatttgatatttacttgccaaacaatgttcaaagcacagtggttaagcacgcaggaactgaagcaaaactgcatgattgtaacttggctctgccatttaaaagttgagtgaccttgagcaagtttttaacatctttgtgcctccattcctacatctgtacaatagagataatagcagtatttccttcttagggaggttgtgggggttaaatttgttaatacatgtaaatgacttagaagaatacttagaatatagtaagctttcaataaatatcagttattgtttcatttagtcctcctcactatacagtgagatcggtattatttttgtcccaattgtatacataaggaaactgaggcacacaaaaggattaaacaactttccccagatcatggagctagtaagtggtgaagttactattcagtctgaggcttttaatcactatactatagctgactctgtagatgacctcgaaatctaattctaaggtcataaattatagacatttaatttcagtgactttcttttgtctttctattgataattttcctttggcattcatggtagacaggattctaagatgacccccaggacccctgtcccctggtatataactgccctcttcttcagtgtggttgagaccagggaatacaatgaatttcactctcatgattaggttttgatctatggcaaaggtgaaggaatttcaaggatgtatttaaggtctcttgtcagttgactttaatataattaaaagagagattatcttggtgggcctgaccttatcatgtgagccctttaaaacaagattcaaaggaggcagatattctcttgctggccttgaagaaatcagctgccatgttgtgagagggcctgtgtagggagtcacgcagtgaggacctgaggacagcctctgggagttgagaacaatctccagatgacagccaacaggaaagtggggacctcagtcatacagccacaaggaagtggattctgctgacaacctgaatgaacttgaaagcagattcttccctacttacacctccctgtaggaatacagccaagttgacagcttggtttctgccttgtgagaccggggactggttccagtgcctggactcctgagccatggaaactgagagaatgtgtgtttctttaagcctccaaccttgtagtaatttgttacacagctatagatacctaatacagtatcattaatttaaatttcaactcaagaagaacaaaaacaaaaaatgtattttttaaagccaaagagagactagtagccagcagagaataaatacgagaacaattcttttgagaatttaaatataaggtactatattgcctcctaacttatttgattcatgtcttatttattataaatacttttttgattagaggcaacaacatgtcattgtgaaaagaacatttgactaagcatcagcacttctgggttttagtcttgacttttccatgaactttgttgtgtgacacttaacctctcatggatccccgagtgtcattcaggaagattaaacaaaatgatttcaaatcatctgtctcaaaattctgtgaatataaggatttaagtaattagaagcttgtagtaacaggactaacactgtcaataagctttaggacctttaagttttaatgtgggaaaatgtaagaaattaggaggaaattatgcttttaagatcatgaattttgacttactaattttaacgcataataggctgttaggggtcattgcttcttttctgttatcaggaacacaagggcagcatgctcagtgtcagtgatggtaagcacaaaaccaaatacattagcagaaacactgtcccaggctatgaaattcttgagtgtagtagttggcgtttgaatcatgtaacagacacttagtgattgttgaaggcatgaatggcttaatgaaggctggtgatttttgttgtgtttttccccaccatgagagtttgacatgtaaagggattgtaggagttttccaggccttattgggatgaagttcacatgacctttatttacttgcaactatttgctttctcaagctatttgaaaatcttagtctttgctgtatataaatataattttaatattgggttaaaattggaattttattctattacattagtttttcaagtttaaaaagtttttctccttcaattctctgtactcgtatgaacaagaaattcttcctgtgttgcacgtatgtttattacggcattactcacaatagcaaagacttggaaccaacccaaatgtccaacagtgatagactggattaagaaaatgtggcatatgtacactatggaatactatgcagccataaaaaatgatgagttcacgtcctttgtagggacatggatgaagctggaaaccatcattctcagcaaactatcacaaggacaaaaaaccaaacactgcatgttctcactcatagatgggaattgaacaatcactcataggtgggaattgaacaatgagaacacttggacacaagaaggggaacatcacacactggggcctgttgtggggttgggggagcggggagggatagcattaggagatatacctaatgtaaatgacaagttaatgggtacagcacacgaacatggcacatgtatacatatgtaacaaacctgcacgttgtgtaaatgtaccctagaacttaaagtataataaaatatatatatatatatatatataaaagaaattcttcctgagttggagaatgtgtatatggaataataattttaaatactaatttaaattctgtttctgaatgttactctttcaaagttacctatgattgttcaacagttgtgtcttgttagggaaccatcataagagtgcaaaatttctagctcaacagaaatctgtcaagtactaagatactaaacatactatatttagtgaggcgtatacttacagttctcacaacttaatatcagaataaatgtatgatattttataaaaaacaaagcctcccttgttcccccagtacaatgcacatgtcatcctacattggcacagagttgcagaacttataatactgaattatactaatattcaaataaaacaataaaataaaaacatactggctgggtgcagtggcccatgcctgtaatcccagcactttgggaggccgaggcaggcaaatcacgaggtcaggagttcaagaccagcctggccaacatggtgaaaccccatctctactaaaaatacaaaaaattagctgggcgtagtggtgcgcacctgtagtcccagctacttgggaggctaaggcagaagaatcacttgcaccgaggagtcagaggctgcagtgagctgagattgcatcattgccctccagccctggcgacagagtgagacttcgtttcaaaacaaaacaaaacaaaacaaaacaaaacaaaacaaaaacccatactttattctttagacattttaattgaaatattatttatatcaataaatatttaaacatgtacacaactgtttatcaaaataaactttcattactattttccatgctattgataataagcctgaattgtttaaactgtatttaaattgtaactttcacatcattgttgccatcttaagatgtatatctatctgttgcttccttaatttatcttgattttatattttatactcttattccttgtatatacgtatatacccaaaaagtataaatttctttttgtaaagctttttttaaccttatcagccttgagttctttcctgcatcaaatgaattttctgactttttaaactaaagatatttttattcatttgttccagtatacttggaagaataattgaacagtaccccacttacttagaaaagcaaataaaaatactttaagtagctcaataatgcctaagtgtgcttccagactgacataagagttttttctgtcccttagctttttaccactgtttgcacttagaacactttctgcatttcttttttaaaaaaacaatagctggccaggcgtggtggctcacgcctgtaatcttagcactttgggaggccaaggcaggcgaatcatgaggtcaggagttcgagaccagccaggccaacatggtgaaaccccatctctactaaaaatacaaaaaattagcggggtgtagtggcaggtgcctgtaatcccagctactcgggaggctgaggcaggagaatagcttgaacccgggaggtggaggtggcagtgagccaagatcatgccactgcactccagcctgggcaacaaagtgagactctatctcaaaaaataataataataacaatagtagctaaaacttcatgtattaatcttaaaagtatctgataaattcagatataatgaaagaaatctattcagacataatgaaagaatgctatcttattattggttaatgtcttaatgtgggattattattttttgaatccccacattaaaatgttgctttattttgtgctaaatatgctctgctctgatctttttcccctttaaagcttatatttaggtaaaccagcgtgtatgtgtgtgtgtatatatatatgtatgtgtgtgtgcgtgtatgtgcagatagatagtatagaacagaatacaaaaactttgcatttcagcctgagaatatgatgtattatattcatatttgaaattaatataaactacctgagaaaaaaaacacacaataccataaaattcagcatatgacactcttcagttttaaaagattaagtcatggctacccttgtctgttattcagtcattaatcctttgtcaccttgggtagtttataacagaatccagaaagtcagttaaacatttatttccatttcatgttctctgtagcttttttaaggcatatcatttactattctttaattttaggtacaaatttttcttctatttttagaaataaagataaatataatttaaaatacctcgggggctgggtgcagtggctcacgcctgcaatcccagaactttgggaggccgaagtaggtggattacctaaggtcaggagttaaagaccagcctgaccaatatgatgaaaccccatctctactaaaaatacaaaaagtagccgggcgtggtggcgtgagcctgtagtcccagctgctcaggaggctgagacagaattgcttgaacccgggaggcggaggttgcagtgagccgccactgcactccagcctgggcaacagatcgagactccatctcaaaaataaaattaaaataaaataaaataatttgatatgaatattgcgaaaatagcaaataataacagtggttactagtcatcttctagctagtatagagttgtccttttgctggtaaaattgctctaagttttcccagacagccatgtctttcacagtctcagttctaatattccttatctaaactacattctaaattgcaagaacacttgcaagcctgccttatattttgttatactatgtagtttaaacatgttatataacatccatctaatgtagacattgattttaaacaatacaaaatgaaattgatcaaaaaaagtccagtgctaagcatagaaacagaattagcacaataatgattaggaattcaagtccttctgccatgctaatgaccttggtctatttagcctccttctcacatctgttaaactcgctataatacctactttaggaagttgttattaggataaacgagataataaatatgaagtatttagcattgtgccagacacatggtaggtgatctacaaattatagctaataataatgttgttgaattataataaaagggtatttttcttgctattttatgattttctttttctagaatatgcttaggtagtaatagataatattgtgttttaaaatataaattataataatataatgtctcacatgatttcacttaatgaatagcattgaccaaattcaggttttgtaagatacattaaataacttccctggaactttcctatagtgctgctaatgtggtttcctgcagtaacttgatgtatgatgcagtaatgagtatagaattagcatgtaaagcaagaccattttataccccttctaattgccttatttagttaagtgccaaatgctacaatataaagtttctagcgtattatctctaaaacaggaagcaaagttctaatggggtttcttttctaattctattttttaagacctttaatctgttaactcctgatagctttgctggtaaagtcaatgtgtttactcaccttttgtattcctagcagcacctagcacatagcaagcatttggcaaacaaaattactcaagaggaatctgagaagacgtttttgcaacttaatatgatgaatttaattggtattttcttttccctaaaatgtctacagtctggtatttctgcctttcctttttccactccagttctataaaactaccagtgcctgaataggagagctactgttgctcattacaagagtgttatatgaggccttgaatgttgtaagaaatatacatatgtatatatagacagagagccatttatatacatccattactttcctatttatgtattggactcttttgaaatatgcttcaatttgtagaaaccacaagggttctttttaacatactgacttcgtacccttcagattagcatgctatccaagtatcctgtatagaaacccttcagcattcacagtgttatctcccctacttgagataaagagaaaataagaatgaaaatataaccacataggtaagggaaggaatagctaaaagatttaattctgccattatttttcttcctgtcaaacatagaatttgaaccgcagccagtttttatatgttaagtactgccattctgtcctttctccatggctgctgatgtatatttttaagacaaatttttaaaaatacagagaatgggattccaggatgggccacataatttgtgagacctagtacaaaatgaaaatgccaagccccttgttcaaaaacaattaagaattctaggatagcaacagcagagcataaaaccaagtgtaggcccatgtgcaactgcacaagtcaccctcccacaaagctggccctgaagggtttcctatttcaggggaatgatcttcctgttggcactttgcctagcagcttttcagagtaaataccttcattgtatctaagagcattgagacctgagcgtcagagagagtaaagagatgtgaactgtccatcatggccatgcagctagactaaccagtgtagttactgatcattgtaagatggtcagcaaggtaattcaattaagaataatgagataattcataccatgaataggatttcagtattttaagggttgagaaagcaacagaggaggaaaaagcatttattgggtgtcttttttggataggagccatattgaactctttttaatgcattatcatgtcttagcatgtcagccatataaagtaatctttattagctcatttcattttctatctgaggaaagtgaatctcaaggatataaaataacttgtttatagtcacacagcaatcattggcagtgtggtgattgcccacaactgtcttcagatcaagcccatgttctttctatgggtattggtaccatgaggctgtctctcttgaggggctgatagacacaataaaagtacagacttgagaagcagatgcaaacagcactagcacaattagcgaaatttagcatgacagtttctttagtgtaaagaatctgaacccagcacaaagtgaggccatggaccaaggacagaacatagtaaataaaaagagagttcttattatcttgaccagacaggagaaactgttgtgaggggaaaataaatctcgggatccccaaatcactaagccaagggaaaagtcaagctgggaacaatgtcagtcaaacctgcctcccattttatttctaaatacggtagctacaaagataagaagctacatacctccctcacaatttgcccacaaggaaataccttgtggacaaaggacagacagaactcaaagtcattcctctgaggctcacctgagacaaatgcatatctgattgcttcctctgccctctttgtttatataaaaatgcagattcactgagccagactaaattttgtattcagtggaaggctgatcaaagactcaaaagaatgcaaccttttgtctgttatctacttctaacctggaagcccccacttcgagttgtcctgccttacaggactgaagcagtgtacatcttacacatattgattgatgtctcatgtctctctaaaatgtataaaagcaagctgtactccaatcaccatgggtacatgtcatcaggacctactgaggctgtgtcacgggcgtgtccttaaccttggcaaaataaacttcctaaattgactgagatttgtctcagatattttgggttaacactgtctacctcacagtagactaataacagtggctacagaacaaatgtaacatgttggagatggatagatgataataccttgattgcaaaataatagttcctcctatagttaaagcaaaaaaaaaagtttcaaatgatgaaaatcaggcttcagtaaatacaatgagagtctgtgaagcatctgagggccagcatattttagggcagtatatttcaagcttcttcactcctattctactttcttcatgattttgccatgtgtaagccttaaaataccatgatagctgtaacacatattttacatttattgtttcatacagttagtacgaatggatttatcctgacaaaagcactagctttctgtccttagtaaagccactctactaattgtttaagctcatttgctcttcagttcattcaactaatatttattgaatgctttgtattttctaggatttgtctacctgatgtaggtggtaggtgggggtggagggaaaaagataagaagacagagatgagtagggcatggtacctgcctcagagggattcagaataaaatagtttcgcagtttcagattgttcatagaatgctgagaaagcaggattgagactttgcctggaggaggtgggaaactttatacaaagttgagcaggaaagtctagataaataagtaggaagagtttgttaagcttatttggaagattcatctttcctggatcttggccagattttttttaacttttctgaccatgaattaaaagacttcgagattttttatagtgttcagttcaatcttgtggttgtaatcaggaggttctcagattaagtttgtttaaccatcattttttgtaggtatggtaaatcaaataatagaaacagtataaccataactaatgaatattttggcatatagttcttacactcataatttagaatataggtgtgttgtgtgtaaatgtgtttccatttcacctgaatttctttgtacagattttacagaataaaatgccagttactttcttctactgtttatttttccttatgaaaacgttattacaaaaggtgatttatatgttacttacaacacgtatttaccacaactatttttgtttttgtgcttccagtgtaaaactctttctggagtctgtgaccacatcatatccctgtcgtcagatcctctggtttcacagtctgctcacctggaagtgattcaactggcaaacattaaaccaagcgaagggctggtaagagataccatgtttatcaaaaccaccatccatcagtagagagctaatgatgtggacaaagcagcctctgaatgtgggaatctatgaatttcaacagacactgaacattttggtatttttttcctggaggagttatggtagtggaagtttgtgatgcatgataagaagttttatgaagataaatgaaaatgaaggagaattgaaaatggtgacttctgaattaatttaatttggtactcatttagcttcaattacattctttcacctccctccctaccaaagttccttaggtttaaaggaagtttaagagttttataataaacaccacaatgttacctgctcatgaaagttggttttttgtttgtttgttttgtttgttttactttggtttgttctggttttaatagttattccttcccctagggtgggttagctaaacaaaactgatattctttataactcgcattcattcttagaagggtaagtaagcacgtggatattgccaacactagatgtctatgagttgtatttttttattatgtaataataaatataatcatgtttgatattttgttcacctgattaaaaagtgtattggttctagatttaacccaagagagagattttttaaaatataagtctataggaagaaagcatataaaaattgatattgagacagaaaacaagaaactggctagagaatatcttaactactacacaactattacatgttagtttggtgctatagtgtttccactttctccctgtatatgaatttaccaattaatgatattttggaaaatagaaatcttgacaactagcattaataattgaattcagataatatattctttaagatctctaagcaagtttaactttttctgtggcttttctttttcatacatctatataactgttcagaaggcaaagcctttattgactaccactgatttttcagtttgaggccatctatcctagagagtaagttttctgcagatatgtggcaaattaattctggttatctgtagttcctagtgctgttgtggcttttatgggtgttttcctgggaaggaatatgatgaaaatcagcatatcagacatagcatgccatcattgtgatctgtaagtgctatatctaatgttgattacatttagaacttctgttaagtaattataatctaaaatttttttattccttttagttacatctacaaagtccagttttatttttaaaacacttcaatctatagcaataaggattggcctttctatgtatccccttttagtagttataagggaaaggaagtcccctaagcatgatttttagagtgaaaaattatgaactaatacaacattgtattaaactagaagtcagaacacccagatacaaataacttacataaaatataactatgagagtgatcttgaagagatgggagagtaaatttaaccaccttggccttgatctagtcatgtaggtgagggagatgaggagatcatctttaaagctccttctggctcttagtctgtggttctaaaaagaaaaaagcctgactttttttctctaatttccactgaaatcattgggagaaataaccttgtaaaataagtcaaaacaatgctaattaatgggctttatgaaatcttgattttttaaggaaggtatagccctggacaggtcctttattgttttcatttgaaagaggtagatctgggaacttaaaatgctaagaaccagattcagttaaacagtttaggagagagctagaagagaaaagaaatgaatgcccatcacttgccaggtatttttctcacacctctatagagtagatattaattttctcattttgcaaatgagaaaataaaattgcacatattcaccagtttgctctgtatcacatatagacaataaataacagaggcagggtttaagtccaggtaaatctagatgaagtacatctgaacaaagctttttttactattccacattcaaattttgaattgctaaacaggtatgagaagcttaggaggatgactttaaaactgaaattacttagagaaatttgtttttaaaggacaaggggcagcacttcactgggaattgaaaggaaggaaaagaaaaactcaaaatgttgaatattaatagaaagagttaagtataaaactattttttgtgattcgtatcaaaggggaagtactaaacagagaatttacatggcttattcaaggtatcgttttaaaactcagtcacgtttaagtaagtttagtcagtcacatttgaaataaaccaattttaggattttgatttaggattttggtaattagccatagtaaatgtctaaatgataaatgaaggaaagaaatagaaagcggtgggagaataccaagatttaatgaaatttaattagcttagaaatatccacagaaggtgttcttccaatgttaggacagaacatgtctcataggcaaaaggtaactgatttgttctcctgctgataaactggatacatcgtttatcagctttctaattagtcaaatctcctagaatttcttaggtttaacagtcctaaagcattgtaaggactggtgagaaacaaccttagttatgattgaaccatatgaaactttcttctaaagtgcttttaaacaacaataattagcagaaaattaaaggaaggaaaatgagagctattgaaacaaccaaactggatcagagccaaggcatgagccaaatagagaggaagggactggggtcatccctggggaaacctcttggcctcagggagttctttttctatttgggtacttggaccatctccaaatatgccttattccaccaacttgactgagaggttgctttggctcctgttggttaaccaacatttggagacagagcaaagcaaatgtcattttggcaacctgagcaggagagagggagctgtgcaagtcagctctagaattaattaatgaatttttaagaagagagaaaaggaggaatgaaggttttgatgaaatggaaagccatatttgtcacggttccagaaaaagagtcatttgaattacatgtcctcctgctgtttggccctttctcagaggtgaacaatgaatcagatgtatttctctggaccctttcttattcagaagatgattagtttgaaactcatccaagcaacttatttcttctctttcttttggtgcctgacttttggccatttttctcattactactatgagagggagattaaaaaagacaaagaagtcagttttgattattaaaagcagttacaacatggtttattgagtttagaagtgaaaatattacataaaacaaaatatctttattcttgtggcatttaaaaatttgttttatttctaccctattgctttatgtctatatgtagatacatctctaagcatttaaaatttttattcatctgaaaaaaaatagctttaatataaattgtacaatgttgtcatgatgagatcctcttcctataactactagatactgtctttggcttacaattgtcagttaagttcctggtatttgtaataattatacacagataaatttagagtcatagctatgctgtttccatgattttttattatcccaataactacagtgtcttttctaaacatttttctttaaatattaggctttctttatgacctcatcatttatagaatcatttaggactcttgtcaaacacctttaattcgtagtcaatagtgaaagatacatggagaaaaatagaatcaacttctgcttacagttgtcaagatgttgacagctgttgtgaaacctcggttcttcttagtttaaaagaacttaaacaagagatacacagcaaaggagatgtagcatagagcaatttattgcaaaggaaaaagaatattgtgaaagttaggtgcagaatagccagtacaccctgagagaggattcagggcaggctgctcctgaggatgagaccgccaagactggcactagggagactccctttatgggagtcttacgtgattatttatatgggggtgggaagagctgttactagtaagcatgttctgggtggtcctctgggtgtgcacgtgcacagtagctgtacatgcctgttcatatgttgcatgtctctttagcatcttaaatctccacccagggctgtgctttttactattataatgagcaaaggcttagtttgaggacaggtaaaatcaaaatgcacgtgctccctccgggggaaatttcctagctgtgcttgaatgagcttgactacattgtgaatgctggggcttattgtgttaaccatacattcgccacagttgccaaattccaaggacatgttaattccttgactacctatcctgcctcaaagagagatgggtaattgaaatgaatttgtaaaatatcaatcccagttattcttttagctacatttcatatactacatatttgctaaagtggtcttagtcttttagaacagatattaaaaagtgaatgtttgactttaatatctacagtcatcaaatattctaataagaaaagttaaggtgtacaactctcctaactgtaaataaagccataaatcaggagcccagtggttgagagtgtggactctggagtcagactgcctgggcttgaaagctggcttcaccaccttgggcagactccccagcctctctgtgcctcagtttccttatctctaaaacagagataatgatagtttccactacatagactattgtgaaataagtgcaagacacttaaaacagtccctggcacattgtaacaagtagatattaatggtggtgatagataatgatggatgataattattttgtgtgtccgaacagtgtattttgttttgttcactttttccactttatcctctcacaacccttatatgtcaaaaactaaaaattggccaggcaccgtggcttatgtctataatcccagcagcgtgagaggccaaggcaggcagatcacctgaggtcaggagttctagaccagcctggccaacatggtaaaacccgtctttactaaaaatacaaaaattagctgggcgtggtggtgagcgcctgtaatcccagctactcgggaggctgaggcaggagaatcacttgaacccgggaggcagaggttgcagtgagccgagattctgccactgcactccagcctgggggacgaaagtgaagctccgtctcaaaaaaaaaaaaaaaaaaaaaaaaaaaaaaaaaaaaaaacacgaaaaatttactctctagctcttacaaatgtgcagtcatgcttcatttaatgacgggattccattccgagaaatgcatccttaggtaatttcatcattatgtgaacaccatagaatgtacttacacaaacctagatagtacagcctactacaaacctaggctagatgatagagcctattgctcctagtctacaaacctgtatagcatgttactgtactgaatactgtaggcaattgtgacacagtgttaagtatctgtgtatctaaacatatctaaacatggaaaaggtacaataaaaatatcattacataattatatgggaccaccatcgtatatatagttcactattaaccaggacgtcattatgcatcacatgactgtattttaagatcctttattaatctgatataatattgttaattcctgaatgaaaaatatttacagagatcttgtcctcttctaagttctaaaataataccattatatttaccgatcagtaaataatggggtaaatgttagcttcaaattaagtatgttgtatacctgtcaccagtgtaaggctgaatattaccatgttgtcataggcaaaaactactggccaatccattaattaaattctgattgtacttttgttaaggttatttgttttatataaagtgataagcattcattttgtttcatattagcaatccaggctcagccattttagacatatggtattactgaaatgactttttagaattaaaatctacccagtgatttctcaatagttccataccatgaaatttactacttatttttctaatctcttattttcagtgaagacacatgtattttcaggtatctaaatatataattaacaaaggtataggaaattaacattgtagcaattgcttcatgtaagtactaaatgtatgctttttctgaaatggtattgttggttgttattattaaatctatatttcagatttgaagttaattaatattaatatttttatttatgaagtaagtattttgaaatgcaaaccacttttataggtaaaatttgggtagtttttccccgaaaataaatttaaagtaacaatcttctttggaggggacaaaaattcattaactgaatcatctagtttgttctgatttacttaaattatttaatattaaaaatgtgaatcccttattgtgattttttttctttaaagttccatcactatccataatttaaagtttccacttgctcttaaagtttgtatgatttcaggatttctgtataatttttaaactttaatgtagttttttctaaaaatggttctatttaaatggaaagtggaatcttgtcctttttactgggggaagggattgctacagatacacactaccttttaattatcgatgtagatatgattggatataattagtaaaactttatcaataagaaaggtggaaaatacaggatactacaaaatagaaggagaaaatttatgtaaattatattttatcactcttctggttccagttataattgaagtgtctcattagaaaactactttccattgtataatatatcaagtataataagttaataacataccaatattttaatttcccattgtaacttttattttgccacagaatatgcagtatgggtttttggggagagtgagagagtttctttcttaggaatattgaattaccatgctgcattttatcagtctcacaggcaattcacttatcaagtagttatttaattgagtataggcttcttcagacaaactttagaaaccagaatgttcagatagtaatttctcaccagtttaaagatagcgtctgtcttcatggatttatttctggggcgtgtggcagttttaatttgatagagtaattttttatataaacgaggttacaatgtacttgaaaattcaccaattgcttcactttcttttctgatgctgtctttttcttagggtatgtatattaaatctacatatgatggcctccatgtaattactggaaccacagaaaatgtaagtattctaacctttcaaatttttaagtgtgtttttcccttttattgctaacaacttatatatctcacatgattgaggttaacatctaaggataaggacatgaacagatagtagatacaatttaaaagagatactgagttagtagcattcattctgttcaaatttccctttttttttgtttagaatagctgtttacttaaagtaaatcaggtgttttcagccagagatttgtctttgtattttctgattcatgacaagttattgtgacatctgaaagaattcatttccatctgtcaaatgatttggttatttaaagaaactaaactcatgcgagaaataaatatcagataagtcaggttttctgaatacttccagtataattcagcttaattcagtggaagggcagcatggtatagctgagtggttttcacagtgacattcctggacaccagcattagcctccctttggaacttgctatatatgcaaactgttaggccctaccccagacctactaaatcagaaattctggagaccagcctatttcttaataagagattctattttaacaagtgaatctgaggcatatttgcgaaccaccataagcagtgggccagaagtccacaggcctatgtctttacaaccagttctgcatcttaatggcagtgtaattttgggcaagacatttaacctctcattgcttcagtttcttcgactataattggaaacaaattatctgcactacatacctcactaggttgtaatgaaaattaaataagctaagaaaaggccatgctatagagaactatctgtgttatagagagaaaagcatgaagtgatcatgctggatattattaacatgatcagtgtgatagaggtgaacagcataatacatcatcattcttgcatttggttatttcagatttccattctattattatataagcaggtactgagctttgaatgtattttttttttattttagagattctgccaattgcatgcatatgcagtgctcttttaaagaagactgaggtggaattagttcaatctcaaattattattgatctgaacattttaccagcattttctttttaaaaatcaacattcttttcatctaattcccctatgtaatcacttactgatatttttccttgcttctcttggtttcttgtgaaaggtgaaacatatatatttgcagttggagtgcaggagcagcttcacatttggtattaaatatgagagtcgtagggatcaagaatatcagtaacatgcatattatgaagattttaacaattttaaatgcagttaagatgctacaaactatatgcttgtcatcaattgttcattctgatttatttattcattcatgtattcatttgttcatttaacagacctctgcttcatgtctgctatgtttcaggcatggtgctaggtattggaagaattttaaaataactagtttggtgccatcaaggcgtggagagcatgtgggggttcatctttataaacagtagtgtaatttgcatggatggacaaagggaagaatagtaaatactgccaagtgaaatcagagaaagaatcacagaaatggttattttgaactgtatcttgaagaattggtaggaatggatctctatattgtctcaggtctgcaaaaaaatgtggagcactgtcttgctcatattactcactaatgtttcataaatagataagtgatcaaaagagagattgagtctgggagtagttcagatatgaaccatatattaatagttcatcttttgattcttttttttcttaaaaatatttaagtatttttggtaacctcagtcatttataattaggagatctgtcttgagtcttagtaaagctgctcactagagtgggtaagttattttgctttgctgtgccctaatttcttagttttcttatatgtgaaatgaggcatttggacaaaattctatctctaggatctcttttaaaactaaaaatctataatttatatgacttctttacttacctgtgcaaaatgtttcagtttctttgaattttatatactatcattttcttctacataatgactagagccatttgctcgatattttttccatactttcctttaaaaggatcagttgtgaaccaaataccacaggaaccaactatagttacaaatatattaatgatttacaatcttttcagaattgtttcatggtacttgtctgacttggtaatatgtccccctcctaaaggtgctgtgagattaaaatattatattattgttatgactctattcttagagttttttattgtagattgatctatccccttaataatgtaattgtgttattacttcagtaactagaactccctggtatgttgtcttatcttgaattatagcctatgacaaataattttattgtgaattttaaaaatgtgttgaatggaggttaacattgtttcaagacttctatgttttaaaaataattggaaatgaataaaaaacaaactggaaatcacttttaaagtatgtcctactccagggtctcaaaagtagcattgtactttgcagattacattaccatattcttcttctttagctttcagtagataataacgaagagtatcacagcatttatgtttgtgtgtgatagataaacacatacacatctatctagacaaatacatttttataaaaatggattttctatatattcaaaagcatattaaaatgcatataatcaataagtagctaacaagaaaaatataatattttaaattcattactcagacctgcaatataaaatttctatcttaaatctcattttaatttcctaaaaactccttaaaacttgtcagtattagcttaccaagtttgtttgtttttgtttttcatcccttttgggaataaaggaaaaaagtgttagattattgcattctatagaaatattggcattttagttcattgaatgtggttttactgtccagtgtattacactatatgtaacatgagaaatagcatcctcttataactagacacttagcatgttatgtaatatgatttgaactaattgctgtccatcttttaatttgctttgctagattattcagaattggtgttactgatgaaataaattagcaatttaattatcaaacttcaaatctttgatgctgatcatattcatgtacttgaaatggatttgttgaagttaatgtgaattatttatatcaaatggaaaggatcacaatacaaaaagatataattttttgaaatgcatttttgaagcacttacccactagagcctaggagagttgcttgtataaagtttacaaaggttaataccaattatcattttttcataatgctctcagaaacgtgttcttttataataaatatctatatattattttgcatttctgtttgttgtcattagctatgcatagaatgcaaactattttttattaatttttttctttctatgtttatttaactggctcagcaggtaaaaacagtgtattaaatactaataaccgtgtttattgctttaattccttgaaatttttaattaatttttaaatctaatttatggagatgaactttttgtagtgtttccagagacaggaaatgactgataaaatttatgttctttatcgtttcttttatattaaattcagtcacctgcagatcggtgcaagaaaatccatgctggcgatgaagtgattcaagttaatcatcagactgtggtatgtataattaacttaagagtcagtgggaggaactaattttgatttgctaaagctttaaaagaatgccaatgaaatgaaattcctgtttgtatacaaaatattgaacagccttttgaaaaaataactgaatatttattcttcttaattatttgatggaacgtaaagcatttttttaaaagaacctgaagagcattggtggtggttgaggttagatatacatttctgtatggaaaagtactagataatagtatatattccatgaactggaataacaattttggaatagaaattaaagtgacagtatgtataaattcaaccttttcttgatacaactttttgaaagtttcattttataaattattgaattacctagtagatgttttataacagcatacatccatttatctaacattgatttgttcattaaagtatctggtggttttggggggagtattttaaatgtagatctttgaaaattttaaaatttttaatagctgaattagctttttatttcctaaaagaggacaacagttttcattttaaaaaatgttcttgccctatgaacctcacaaatccctttgttatctacccttaaaaatctacagtaggcacagaatcccactgccattttttataatagtgggattctgtgcctattgtagatttttaagggttatttttcttaaacttaggtttagaaaatgaacattatatgcttttcattttggactattttatatgtctcagttgattcacttttttccactctctctgccaaaataaagtatatttgttatcttaaaaagttaaaataatccaaaattattaatatcataactcatttgaaaaaaggcagagtttttattagtattctgctcctcgcttactaactcatcagagtgagtaattatttcctattacacaatttaactaaatttgcttttgcatgtcctagtgatggaagaaattttgtgaaaaacctgatttttctcagtgattctaatcataaggcaaatgacatttcaattttggttttgaataatttgagaagtctgtgatattttggaaaggctcctagacactgataattaaagccatgatgtctcttcaataagttcattatctaagtgaagtaaaagttggtaaacgttttcaaaattaaatgcgtgggtgtacctttgacactgaataatagagtgttggtagtagacaaagcctttccacactatgacagttttgatggctttcttttctgattactagaaactgtacaaagtagttgttctgactgaagtttcctgtcccataggatgaggatttgggcagtgggataaagcagctgcttcagtagacgagtagcttttccctcttctaatgtttatgctgcttccatttctgcaatgtgaccttaacaaacatgacatctgttgaatagtttcagcatgcatttccagatggtcattaagaggatagagattagtctctaataaaaataaaattatttaaaggatattgtttgtggaacaaagatactggtgtttatgaaatgaatatgaaagcctttgaaagtctacaaataaactaataaaatctatgtggattggtgacatttaaatacacctagaatgtgtaaatgcatctttacatcacaggaatattctaaaatattgaaaactacacagaatgatctttgggaaaacttggttccagctcttgctctgaaattgacttatggctttaagtgagtcatggtaactgtgcatctgtttacctttttctaatgataataaccatagctaacacttattgtgttcttacagtgtgccaagcatcatgttaagtattttacatattttatttcatttagtccatgcaataatcctgcaaataaggtatatgtagaaattgagactcagaataattattcagctcacccaaaactcaaagttctttgactctaagacccatgttcttacttcaattttattatactccctcccaaaactcaaaaattatataactatccaacaaaagaggaagaatcctaacaagcatgtaagtaaatctcaggattcaatgaaagattaagtggggccaaggtaggagaagaagaaaggaagtgagaatttacatagctgggatagcgagccagctgaactgaaattagaaatagggttgaaacttaactttactgccacttcctcactctgcttctttcactcagataagtaagatatgtaaaaacacctgtcataatgccgggcacacattaggagctcaataacaactttgcaaccgcctttcttctcttttacctgctacaacagttggaccaattggaatcctccttcttggcatactgctactagagccaacaaattgattttggaatataatagagacaagatagtatgttgaatttcatgaaagtagacttttttaataatatgatcggttgccaggtttttttgtgttcaagtagaggcatatttgggcaaaaccaatgcatttcactaaatgtagcctactctgccctctttttcttgctgttgcctgtattgtggtctgtacagtgcatttaatctcttattagataatatacagaggtggtgaaatggaaattctcttaattgaagcaagtataaattatttatagtctgcaattatcccttctctccctacgttcattaccatagggtttggttatgatataatagttacattaaagtatggcctaataaatttgaaatacataactaatattaattctctaatccattaattgactagaatagtgagattgccagtattgttccataccaatttagactcattaatgaaaagaacaatgttaaatcttataattttggatgatactaacccagttagtatttttctgtaattctaaaatttcctatgactataggtagtaatgtaaaatataaaatctgatatttttctttacttaagataaatacaaaaattattttaaatatttccctaagagtctaagaaagttgaataaatcagatgaattcaaatactatttttttaaattgctagtatggtatatcttcaagatgtctaattagatgcctatgtttctagtttgctccttttttaaaagtattttcttaattgaaatgaaactggaagttttatgtcctttttcatgttgctatattctctgttataagtggcttttaagtttttcaaaccaacatacttctgtggctgagaaactgtggctgccagataggaagaagaaaaaatcatgaacatccaagcaaagcagactgagtcttattacatgtcttccccaccattgaagatccaactcctcaaaggctgctggaatctcccaagattttttccacttcatctgccactacatccctctctctgggagatacctcggcatagtttgatgcagcaactctgccctcatgatgcacttttaacacatttttttagctgatgagactacttatagttattaaaattattggggcatatttataatctgttcaatttcatgttaatactgtttttggtgtgcaaagggttctaaagattctatccatactaaaaacagtctcgggaatatcacttgagaagagtggcatatatgatggttgaatctattaacaacatttggaagtttttccttttattttgtattaatattaaaacatattcactgttattttgaaagatattctggaacctgatgactacattatggaaagaaatgtttcaatagatgaggctataaaggatactggaatggaaaataaccaggttgggatagtcaagaagaagatagactgcagcaaataggatgttctacattgattagtgagagatggaagataagtactataagctagtggtttttgttacctccaaaatgataaacattgttgagcaagactaaggatggcagagagtgtgggaggagggaacagattgaaggactatctcaaaacttcctctaacttcatttatgcgtctcccttactctcactgttgtctctcattttggactctgtcctcactctcttgttccttcaaccccagaacaacaggagaatattgttcaaaggagaagccaacataatcagaatggatagagagtgtggtatccccttaatattcatctctccttttccctccctctcaatttacctccttccctggacttcagcagaaatgaatgagtcattgagtggaatcaataccatgatattgtctaacagcagatgtactttctttctcttttttgatttgctaaattgttgtctttatttttttggtttttttctaattccattttcttttctttatcattctcatctcttctcactggactatttctcctccactcttcatctcattaagttttctttgttcttccctattttcttctgttctgctttctcagaggagaaagtatttatcatataattccatatacctaagatactgaaaactgagaccacaagaggcagtgtttctggtgtaccccacatcttattcctgtaaacacacatgttgctggactacagagattaattatgttagcatggtgtttaacatattgcttaataaataatgggttcttataatagcctaaaataactatgttaggattctgtgaaatcagtattctaaaatagaacaagtgaatcattctcttttgggagggggaaaaattatgaagagacatataccaaaaattaaggaaatgatgcatcaatgattttagttactcataataatattttatttcagattctaccttatgtagtggtttatgagagcttcatagattgtttttcttttatttcacattgaacattatggatttgatgagaatgtgtggaaactggttttgaagtgatacgtattgatataaactgtatttttattttgtacagagaaatcaatttattactttatcatccaatataatatttcatgtttctgttatcaaactaaaatttattatcttaagtccttatataaaggagataaattgtatgatatctcaataatagttacttcctgttaaccaatttattttctctgcagatctctgcatcctgatttgtttctttcttatttgtgcagttcttactagctttaccaggaagagtagttgcttttttaaaatggttactgtttcattttttatgattaaactttatctttcagtgtcaacgtggttactatgatctagttattttacatggaatttttagtttccttataagtttatttcatgtgtttaaaatgtatctattggctgaagttcttacctactctggcttattaacttattaagtgtatggctcatttgcaaatcagcatcatcctcagtcaccccccacccgttttttttttttatctctttcataaaaggaagagtctgccagtcacaattgcccaatccacttccttttcatattaggagtaggcaatcagtagataacatttaactgcctgataaaaaattatcacatgaaagggaaacgctaaagaaccaccatataataggaaattaaatagatgatggcattaatcttaagttctttttagtttatttagccctaggactcaaggataggtttcatccactaaattaatattctgattggcatggtagctcaaattgtaggtaacatagccactcattacttttacatttcctctcacactgtcccttctgcatcttattatcctaatagtggacaataaaggatttttaaaagttggaaaaatggtatatagaattcactatggtctcatatggagctgacattgagttcctttttttgtctgagttgctggaattttggtaaagtgatttctaaaggtaacttccacagtgaaaatacagccattacagaagtttttcttactaaaaattctattaataaagatttaggatgatacttttagctatatatatatacgtgtgtgctttagttttgtgttgtgataaatatatacatatattgcagtatttgctaaattttcaaataagcatatttttgttacatgtctgctagtaaatgacattgtaaaaatcatttatagcaaagttgtacatttttaaacatattactttttgaatactagggtttgagttgctttttaattttgtcatttaagttcctgaattaaatttaagcatgaattttttgtaagtatagattttccacaaaattattataaatgggagctttaacattttagataaggatgcttcattttactccttagctttggtgactgggagtcttttctttttatttcaaaatacatatttttccagcatctttgtaagaagaacagaaatgaaatataggaaggaatggctgaaatttaataacttaataacccatgtaaatatcttcataaaaaaattagttaaaggcctgtattgtggctgagggcggtggctcatgcctgtaattccagcactttggtaggccagggtggagggggattgcttgaggctagaagttcaagaccagcctgggcaacatagcgagaccacgtctctacagaaaatttttaaaaattagccaagtgtcgcagcatgtgtttgtagttcaaactactcaggaggctgaggcaggaagatcacttgagcctagaaattcaaggttgcagagggctatgatcgtgccactgcactccagcctgggcaacagagtgagactctgtctcaaaaaaagaaaaacctgtattattatggttattttaaaatatgttactgctcttttggggactgaggttctacagtatgatcagaggtttacattacagctttacctttcactacaatgtaattgtcttcctccttttctctctttagcaaaagctttcagacccattcagttttatgttttgatgaagtaaaaggacattgtgaatgatgctgaaataaaaacaaaattggcttttagttttctgtagcatatatgaatgaaaaccatgaaacctccgaaataaaccttaagccttgaaagaccacagcattaccaaatgccatattggaaggggagaaggaaaagtgagctgtatgttcaagatgctgaactatacccacagctttggaatcagcttatcacaaaagtcaagacaccaactatacaaagtccgcagttaatataagtgataggttacaggagatagtgcaagtaacagggtatggaaagtcaccacctttggtaaaactatgtgggtgattcataaaacttacatgaaaaattattatcactattttctttctcccatgaacttcgttatgagtcaatcaagaaattctgatttagctctcagaacttcttgaatgtggggcaaaaagattccaggggagaaaaagtgctagcttcttgtagtgtttgagttgcctctctctcttggactctctgtccatctttagctgtgagaaattatgttctctgttagtgctttctttttaaatactacatatttatacacacacattatatatgcacacatattcataactgtgaaattcacattaagatattaagtattaaaaaagatatatgtaaattcagattgttagcagctcaacatggtctaagttttactttgaaattaagccacgttaaaaaaccaaatgccttgatgtactcttatttcactggataagtgccatttaaagttcaggaggatgtgagatgaagaatggctcaatgaataaagacattaaattgtcggctttttttctctaatgaaaataaaatctttcccgtatttcttcttttcaaatgtttgttccttttatcttttcccaagactttcttcgaatcatgtttataaaaatatcaacactaaagttttatttaaaataggtaaaccttgggacatttctgaatactctgaattacctatttaagttactctaagctagggttaaaaatcacttatttgcatagttccttaaccactgcatacacattagcttatattcctttgtacctgaaccatgactaattctttatttctgttcagtgaataaatgactgtgaaagaacaaaattaagatatctccaaatgtagtagactttaatattgtaagactttttttattaatatttcatgggaaaaaattaggtgaagatggatttcgtagattggtactcattatttaatagttttagaatctttgaaaggcactgtatatcaaaattcattatttctgaaatgtttataacagtatgctatttccttcacatagattgttttcccaaagaaagaggtagtcattggtataaaatgtttaatttattagatacttcagtatctttttagtaacacaaagaaacagaacattataataaatatgtcagcaccaaaaaatttggcaaagactgagtgtcattagtggcagtatgatggcttgtgtgttgaattaagtctcttcagtgctcttaaaaagagcaggaggatatttgggtgtagcatgactcatattaccagacattcatataggcatacttctagtctataaaatttcctttgggaaaaggtatcatctacattacatcctgtgagtaagagtgtgtgtatacacaggagtgtgtgtaaatgttgataatgaatctgtttctttgtcttgtgtagggtaataactttgaaaatattttaagaaatgttctatcttcctgcctgtgggtgtaaagatgctctcttgcaactccaaatatagccatgaaaaaaggtaaaaaaaaaggtctgggttgataggcttaaattcttacctttatgtttatttgtaactggctacttgggaccatagagtagaaattatcttttcatatgttagtcaaataactcaccagctgttatttggaaagcagaccagggcaagttctaaaggggtcagagacaacttcttccctctatgtactgaggggaaaagaagcctatcatctcttcagcaccaaccccaaagcctcttgtgcacctaatccaggcaaccaattttccaggacctgcccacttatgttgtccttcacaaaggaacacctgctgtctgcttcagcctgatcaaaacaattacaagccccatccacaagaaagcagaacctctggcttttagcacttgggattccttaatgaccttcttgggaaattttaatcctgtttatgttgtgtgtaaaatacattttaatgtacatgttggggattatatataaattagtaagctatatgacttgctgttgcttgtaggcactgacttctgctaccttggataatgaagaagataatagtagttcagtgtatgtgaaaaacattatagctaataataagacatttgtgtaaaaatgcatatggtggttttataaaggttcattttagcccatgaaattaatgtgaatgaattactctattaaaatattgataaagcactacaaaatatttttctggaaaaaacaccttcataacagtgtttatatgatgcatatgataaagtaaaatttttccaggacaaataggatctatacccactgttcttttccttgttttaatcacatcattatgactttaggtctggagtattcaagatagaaatgttttttcaaaggttcatttataaggagaaagtttatttgaaattttgaggtacagaatgtctattacagctttagtatcaagtattttacttttttggatgagaggtcatttaatcttttatgcgacaaattttaagtatattacatataaaaaatattttaatactatatcttggttttatgtacaaaactaaaccctcctttcgagtttcaaggccctttattgtctctgaaacatttacatcatcatgtcaccatatcagctcactagtcaagttatgcagtatgccgtgagattcacatgaggaaaatatggtgtcacctttaagaagaggctttatgatgggtactgcatgtaagatgaacctttatggataggtaagattttataagtgagagaaaaattacaagcagagggaagagtggttttgcaaagatacagctaaagagaaaagcacagtgtttgaaggaaacgtatattcattactcaaccaactcttttaattatcaactttctaaaagcctcttataatcatctgaactctgtgtgtttctcctgcctcattactccttcccttgttctgtcatctacgtgtactgaactactgaaagttgctcaaacctgtgatactttgcctcagagctttgtttaccccctcaacctccacatcttcttcacctgtccaactcccaaggaatttggcttaaactcattggaaaccttcattagaccctcaaggatgggttaggtgcccctgttgggggctcctgttgcactctgtattcaccctattgaggtacttatcttactgcattgtaactgtttattgctccttaatgaggtacagactgtgctgcattcactgttgtattcatactacatggaagacacacaataaatacttaagagttgtcttaaaaacatatgaaacacctaaactaatctagacatgagcaagtcactgccttcaaggagctcataatctattacagaggttctcaaattgtggctctttaggccagtaatatcagcctcacttggaaacttgtattaggaaataaagggtcgggggaggaattctcaggccccactccagaactactggatcaaaaactctgggggttaaaactcagcattcttttaacaaggcttcaaggtgattctaacacatgctaaagtttgagaaccacattgaagaaaagtaatctgagaaaaagctgtgatcaactataccgacaaaggacctgtttgaggattggttatttgttccttagttgggcctttggagagctattaaaggttttgaagcatagaaaacttctacactgtagcagtattttggagctgcaaaagactagaagcagaaagacaggttaggattctggtttaagtctagcagtaggtatccaagccagaactaaggcagtgagaagaggcattagttgctaggatctatttgttaggacacaaaatagattaaaaagaggagaaaagtcataggtgactccaaactcccgactttagaggatgatagggaggtttttttgttttgttttgttttgttttctggtgaatgaaagtaaagagataatgagtttgatttttaaagtcttgtattcatgtaagctaccagtggatattcaagggaagatactgtgctttagaattgaaaagacattaatgtaagttctggcttcaccacttactatttttgtaatcttggccgagaaaacaatctctttttgcttcagtttctacacacgtaaattgggtttaatagtttacctcattaggcttttgtaagaatgaaaatataaataaaaagaatgtaacatagatatgaagaatctagcacagtgaattgttgatgcttgcgattattcggtagctattaacgtggacaagctaaacagttggaaatatgactagagttattgataggaagcaggaatggtagaaagatttgggaatcatgcaggaagctgttggtgaaagctcttaaaagagattattgtaagaagacagcatgaaatattagaaagatgtgtaacacttagcctagaggaaacaggtacacttattggtagggaagaggaagaaaagatggaggacaggtaggcagagatgtaacggaaccatgttattttactcaaactaatctttgtcatctattttcatgtttctacccactctatgttttagagttggaatgtattgtgactgaaagttacctaattatttgacctatgcaagaatattgaaacatctcttggtattgatctatttcacaagtcagccaatttcttttttggatatctttttctattagaatatttttcatctctggacgtggtggttcatgcctgtaatcccagaactttgggaggccaagatggggaaattgcttgaacccaggagttagagcccagccctggcaacatagtgagacttataaaatcttgacttattgagtacacctgaataataaatttatattctctcttgtcaatcatcaaggtataatgcatagagcagattttgtttctccatcaccaccttttagtgttttaaatagtagtgttgcctttctggttctgcagttttggtggaaattttccatccataacaaacagtcctgattaggtaattcataaaatttattattttctaattggaatattgctattcatacactaggttcatgtattttgttggtttatttgtttgtttagaagagtaactcatgcttattgccaaaagtttaggaaataaaagtataaagaagaaagtatgtattgcaagtccttactccctttaatctaaccaccattaatggtgttttctatatttatgtacattctttaacaaaagtggaataaaattatgtttgctattttggaacttacttttttcacacaatttttatatcccttactaatggatacatttacataatgtacaggttttggttgatttaaacaatactgtgacacatatgttgcacatttatttttgtgcttttatccaatcatttccttatggtagtggaagtagaatttgggagccaaagatatatactatacagttttgatgtatatttctttgctcttgtttaaaacattgttaatgtcatgtgaataataaaaggctgatttaaaaatagtaaaattagatacccaaattttctgccattaaataacatcagctgtaaaattaaaatccacccaaatgaactttcttgtcagaaaccaattctactttctgatagaaaagcaattctgttttttggaattgttacttaaaaagagcatgtagaaagtgtgaaagaataggatgaatcaaattgcactgaaaatttcacaggaaaataccatctagccttaaaaatcttcaaattttataataagtaaaatgaaaagaaattggtgagtagaaatcaatgtataaatcattgagaatagttatgctggaaaaaagattgtggccatcacattgaccactttagttagcaattatttgagtgaataattaagttacaaaatgtggttatcattaataagttgttcctaaactctttgtataagtagtatgttttctccctccaaacttgtaattcaaagtgtgcattcatatttttttggcaagcaaaatgaacccttggatttgaactccctttgctttaactcttggctgtagggatactacacagctatcagaggaatcggaatcaatgtaatatacctttgggcacataatagtccccacttacatataaggggaggcatttgaccagttccattactgtagttgatccacattaatgtgatttaaaaaaaaaaactggcagtctcattcaggttatccaagtataatgatcattttgattcatatctgagactccctgagattttaagtattataacatctcacttcttgtttgttctaacttcaccaacactcaattcagctatagttgaggttgcaatttagatgaatgcttattaaatataccaaagtccccattctataatagctgaattccagattacctcttcttcatagcctaggggtctgtgctgcttttggtggaagtgctcattctctccagcttgacaaatatcttccaggcaaaaacatggttattattagacaaagggcaccaattatctttaacttggatgcctagaaagaaactgttatcactgttgagaccatttgctaaatcctgcttacaatccaggataaattttgacctagtgtatttatgtaacacatcctggaaaagtataatccattagggtttgggataaaaggttcttctctcttctaaatgtgaattttttttaaaaaaaacttggaataatagacattttaatgtgtttctttaaagcatagtttctaggatttcagttacctgatactgcatcactagtccgttttgaaagcaaagtaacaaaaattattctatgttcagaatttttaaaggatgaagagtgaagtaattttaacaggggatgcagttgagcccgatttcaagacatttatcaagtactttgatttaattacacaatatgtttttaggtgatattcaaatagaatggcttcattaaatttagcacgttatattttaagtttatagggttgtttggaacacattccaatagctgcttcattggagtagtattatcttgttatttttgttctatctttatagcatggtaaaaggtttattgtattgctgctattgtccatgcgtaagaatgttgccttggtgtgtcagtaccagctattggtagtaaaatatcagtctaatttagagacactggtaccacttatctctaaaagatggtgatgagaaagcatgtggtgtagtttgtaagctcaggacattgccaaatccttgttttcaggcatatagattttttaactgtacttgtgaacagagcttggatctagacctagcagctgagcagcattaatggtgacataatttcattacattctgaattactccattggtaggataccattttagtctttgatttgacatggtaaatgtccattatgttgtctggtaatgatatggactaatgcaataatatggttaatcaattcaaagataaaatttattgagtatgtatctcctgaaaattgataggatggtacaccaattatgtgacttttttttttactaatcttattaaagggggagaacattaaatctttgaatactgtacctcaattttattgtaatgattttgctggttaccaggtggggtggcagttgaaaaatttggtgaatgcactacgagaggacccgagtggtgttatcttaactttgaaaaagcgacctcagagcatgcttacctcagcaccagctttactgaaaaatatgagatggaagccccttgctctgcaggtaatgaagcttaatcataagtcatacaccatcattttagccatagattatctcagtaatgcttctttattgtgcctcatctcagcagcatatggattaatcttgtatgcttttgaaaagttgtttgtgaaatgatctcttcacagctattctaataggcttaattgtgatgaaatccttgagtatctaaaacccaaatgaaaaacaactctgccttaatttgtaaacatttaaagcataattccaaaatgtcacaatttatttcatgccaaaatatggatagaatgaaaataagatggttcgtttttatgatatgatcttctattttatgttatacccacatactcttttagaagaagctaaatgatagtttatagaattcttttaaatcagttcataaaatagtaatagtaatttataaacagtaggaaaatgaaatgttatattagtaattaaaatgcacctagtccaaactaggcgcagtggctcacacctgtaatcccagcactttaggaggctgaggtgggtggatcacttcaggccaggagttcaagaccaccctgggcaacatagcaaaaccccatctgtacaaaaaattaaaaacttagccgggcatggtggtatgcgcctgtagtcccagctatgtgggaggctgaggcaggaggatcatgtaagcccaggagtatgaggctgtagtgagctctgatcatgctactgcactccagcttgggcaacagagactccatctcttaaaaaaaaatgtaccttgtacattcctcctgattgatcatttttctctttccaccctgtaaggtggcaaaaatagggaaattgttgcactagaatttttgcatttttcttcagcatgaaacatcactcttcagcatgaaacgttactcttaacattgataatatatttattgagttatcttgaaagttataaaaatatgattctgattgatgaaaggcaaggatgtaatgattttttttctatttcagtcaggatataatctttaaacttaagtaatttttgtccttcacgaaacgtacattttaaaaataagagactattaccttttcttagaagttaattaaaaaaaaataggcccattgaactggaacatggcccattattcatattaaaaaggaaagcagtatatgaaatgcattgttgtcactgctatgtaaattgttattaagctctatgttagtaccttttattattcatagattttttttcctaagaatcaaaattctccattatacatgaatggctttatagattataatgatttttcattgtttaaaactttactacttattggccgttggcattatacttaatataaaaacacatatatgtgtcaacattatggcctttaaaattttaatgtgaatctatttttcaagttaatatatgtaaaactgtattaatatgtccaaatccatttgacttgcatatatgtttattttaaaagatacttgatgatcattacagttcagaggtcaatgtttgcctcattatctaagtcatagatgagtagatcagactttcccattacattattttttttcactgcattataatttgctttgctccccctagagtttcctattgccatgtcttccctaaagatccttcttcaaagtgtaagggtgtgggaaccctgaaaaagaggcctgtattttcagccagtaggttttcttctctgtatatgtgagtgaaatttaatacctcttctttagtccctcatatttcacattaagcaccaaaaataccctagtttcttgttgatccatgcactcggtttgagggaatatctctagcacatgcttttataatctattcccctgttatattcttttccacatgcacaaactgaagtggagagttaaggtaatggcagtacccagttaagaatcattttcatataaaatgctaaaataattgaaagaccaacttttttgttacatatacattgggtgtaggtattcaaacctagagaaaaaggactttaattttaaaaattacgtcatgtcattccttaccctgtaagtgccttactcttcaggcactatttctagatccattccaaattctgagaaatgtgcctcatcagatcactaattatttttatttgtcatcgcttattcagctatgctgcatgtatttgtaaatttactttttcaaaatgctgaaatctgaaaaagaggaaatcagcattatataagtgctgtatatattgacatttttctaaatttgtcatttcagctgaatttggttcaactaaaagctattggccaaagtcaaccatccgtagataaataatactattggttgggggaggggagactgcttctaacatttttgaaaattacttcagttgttgcctttttacagagcagaggaaagagtattggtgttaattaaatattttctagtggctaaaacaaggtcttaggagtgaggacaatgggtaagtcctctaacataccgcaccactaccgaatctccctgatgaagaagacctgaaattgaaccattacagaattcttcattgatcttaaagttctggcttatgctaaaatgcaaagacacctgaaagcataatgaaaactagtcaaaatttttatagattatagattttggtacagaagatggacaaaatctcaaggtaccaggatctggagggtgaaggtacactgcctccagagcaggaaaagttaaagaaatagtgagatgaaaagatcttgaaggcagtttttcataacatcatgactttatctgaggtcaccttttcttcatagtacctaaggagctacctcagatgtgaaacgtaactgctaaatgtagtaacaatcctctacatagacaggagtgccatttttattgtattcttccttctggtaggtgcagaaatacactggagccaaaatgcccatcagctcatccaaatacaaatcttcagcattcaaacttgaaaaaatggaaatgaggttatttcttttttcatagggtgtaccagtagtctaccaagaattatttagaatagaggatacaaaaggaaataatctgtggcgtttatttaactcaatatgtctatttaacctttttgaaaatactatcccaggcttaatttacctgatagcatttatagattaaaatataggaaagtttgtagtagtatggaggtaggcactgatacatgtatctttttaataaacaagtttatcctaacataaggaataatgattttttaaacttataaggaatcgtttttatctatacaaataaaacaaccttatctatcctaagatagaagattgtcaaagaataccacgttttaattaaagtagtagttttatttctaaaaatactaaaagcatagtgacttccaatattgattaactacaatgatgaattttgatttggattttcttttgaaattcattgatgaaattatagccaaataaacagaagcatacaattcaacttcatgctcacagagcaatttcattagtacatttcattaaattggcagctcttttgatgaattcctgatttctcaaatattttgtgatagaacgtaaggacttaaccatcccttagtcaaatactacaagcaaatttaataatatctggaagctttaattctgttgtcattttcacccatttgtaaaaacagagatgtctcatctgagatagaatctcttattctaagaaaaaccagggattccttgctttctgagagctgcttttcaaaacatcttttcagtggcactctactaatttcctgcattttggtaggcatggtgattgcttatcatcaatttcttctaattcaatgaaaaaaaaacaaagaattgtggataaacctcaaggtatatttttagatgtttgtggttttaaattaatatgtgtaggccaagagcatagatgggtggtgtccttttcttcttatgagagatgtatggaagaattatctggacactgccaagaatgttccttggaatcatcactgggaatcaatgacttttaaaacatttaaaaacccagctttttttttttttggtgagaatgcatctcagaaatgatcactaaaatcagtgctggaattctcaacataatgacatatattgttcaagacatttttatataaaataacatcaagctgtaacattataattatgttcctaaattgtattctcatttataaatctctcattttgctgccatagttacttgtatgattttgtgattttgtgtttttccatttaaattttattgtttaacattaccttgatgccatttttagagcatatttaaatacatttgagcagaaaatagaaagaaaagagtcatagtagttgattttgtttatcaactggtgtaacaactggagaatgttgattgcatttgatttcatatacatagagatatgaatggttaaagtcattctggaaaaatcaaaatacataagtaacaataaaatttaatattcaagttgcaggtcgttgtgactgaaaaaaaaacattagtgacaaaaaaatttatctgtttctgagagttttgttttaaggagagcaagaactagtattaggcatggcactagagaagaaaatcaatttttaactaaaaatgtaattgggctgactgggagccagaagcaattgtatgttttacatactcaaatgagtaaatacatgcaagtaattgtcaaattttagctcaccagtctttaagcaaatcagtcaaaggatctaagtcacatttgtatttttgagccacatgctttcaagattttaatagtggctacagataatcacctataatgtaaaaattgtccattctttctttagttaacatccccaaaatgatgtttactgtaatttgagaaaatggaagtccagttttaatgttgcagtttaattatgcccataagactggacaatgcaggattaaagacactagtgttagcctcaatacaatgtgcagtatttcatgatttgatggaaaaagccattttatagtgtgactcttaagtctttattagttatatgctttataagtaatacatgttttaggcatatatatctgtatttttaagcctaggtagatatggttttctgatcaaatctgtggtcagaaaaaaacacttgttttctctgtattctgacaggaaaggaaaaattatatgcttataaaaggatactcaaaccttttgtatttataaatttgcattctagaaaaagctgtgaaagaactgagagtgggagaattttgaatatatgtatttcccttgcttcagttcttttcaaataattgactacttatgaaaagcttggccagaaaaaagtattcccaataattttccaaattagatctaaccttctttacatggtcaagaaactaaaaattatatgtgaattcttgctgcttaaaattcaggatacattttctctgaagcatttgcttagattattaagagagtcaatataaaacaatgttcttgtactagtgttgggaattaaaaatgtgtttgaactgagtaaggacttatgtgaatgttctgtgctagaatgatggggtattgtgatccatttgagtctgtgtttatccccaagagtgaataaaataaatggccaggttttatacttgatgtaattatttgtatttcagtgggtatttcccccctggaaggcaaagcaagttctgtgtgatcttggcattagtgaattttagagctaactacataaatgtgtaatgcactgttttaatctttaacgctggagttgtctttatgtcattggtttcattcaagctgtatcaaagctgggtcacgtactagaaagagggacaactaaattaagatatgcttgcccagagatgttaaaatgtaaaatgttttggggaaaacctcaacatcaaatgtagtttcttaagtatagaagttcttttctcatggtctttaagactatagagatttcacagatacaccaataccttctatatgtgctcagttaccttagagatgttaaaattggggcgcacaaagaaaagacctcagcaatcagaggctttaaagtgagacctcaaccatcagaggatttaaagctttagcttacaaaattttattttacaatcacaatcttccaatgatgtttaagctggatgagtaagatattattgctaaagttatcactcataattcagtggaaagtttgtgtcataccctattttgtgacacaattttaaagtatttatacattcaaactgacagtatgaaaaatacaagttttacctagaagatttctaacactagcaaattgacagtagtacgttatcaccaattgacctaaggttataaatgtatgtttgaagagatacatatgatgattttatttaggatttggacattttaagagatgcatgccagtgcccccagaaatctatcatagacttgttttacaagagtcacaacatacatgtaaatgtgtcttccctgttggagcctcattgaatatgtggaaggagagcttcatctcaaaaggaccattgacatgaaaactaaatggtatgacaaggtccttccagaaaacaaacccctttggatgggatcaaaagtggatccatgtcatacttgattacataccacagaagatcaagttatgctgaagcttcatgtttactttaaataacaagatgtaatcctaaagcagtccctttgtattgtatccattttatccataagtgttgatagttcctaattttcttcccattcatgttttgtcaataccggagaaggtcaaaatgataaaagaatgttaccctttaattctaccttttttcttaaattgaaatttctttgtagtgcaacagtaactacttttcttacactgtattataaacaaatgattataagtaaatgttgccaggataggagaagctatctttttgtattatatcctcctcattcgattttttttcaatctaaggaatatgcctattaaaacctcaatgctgaaagaattctgtgtttcaagttgagggaagctaaatttgttactttctgtgcattttcacaaacttaaatggctattggtgataggtgtatttttaatgccacttgttacaactaggaatttctcactgataattttagctaattgcatcatttattctgtacttgatttagtcaaatttttcttgtctttctaatgttctttaatgcctttttcattcatttagtcatttgattttttactctttcaatttttgtccaaagttagaaaatttttagagattataattttaaattatcacaaagacccctttgggttaagtggttatttttattttcccatgaaggttgtactttactaaactttatttttccattgcttaatgtctagtttttttaatatgagtctcaaaaagaacgtttattatttagcttggattagcttgttaaaaagagcacagttagtagagagaaatatgctgaatatatcaaatatttacaatgagctttacttggtacaaggcatactgatgagccagatggtatttccatgataaaccagttgaaatattttctgtgacttaccagtcaataaaataacaagccagatgagttaagcaataggattgactaatttcttttttctctgaagtagtattttttccaaccagttcaattaattgaaccagcttggcataatcaaacttgttatgtatttaagcatatttaagagtctttcccctctatgtatgtgctaatttaactaataacattaactgatgacattgataggaactgtttgctaaaaatagaaacctagagaaatagcagtttgaaggaaattgagggctaataattacatttcttggaagggaaaagacacaagtaccctaggtagacaattctggtaatagtccaggcagaataaaatattcccttggtcattacctcacacttcaggtgtatgtattttaaaatatgcttgtaaccattgactactactatttccttccctcctttttgtttggggagaagaagggtaggtactaaccaggaaaaattatctttagttctgtagatggtaaaagtaaagaagagaagtcctcaaaatagaaatagtgactccaggcgagaggaaagacaataaaaatttaagtttgattatgtttaaatgcttatgtttttagaacttgattttaagttcatttacagtgttaggatattttaaagtcagaaagctattagagcatttaaaaagcatactgaatattagtttttctctcacagtgtatctgtttcaaagaattggagaataatattctgttaagtgaatgttttctttgctacatttctattatggtgaacttttggtcagatttattgtttagcatcgtctgtatttaaaaccaagatgtcctgacagagaggaaaacagttataaacagagtcacatcacagtgactgtgtgtatgtattgttgaatctgccattcaaggatttgttgtagaggcatgaaatgcatccttagaaataaaatagttatttatttccttgggatttatggtattcatcagtacaggtgactcctatgattacctgtataatctcaggatttcccattgcctcaagttttgtttctaaaagacaggaatagttgaactggaccctattccaaaattagcatagtaaaacataatctttactgtgtaattttataatagcttacaattcttcaattaacatgtaaaacttctgacctttttaaaaatatcgtataaggtggaatattgtaaactcccaaattacattatcattccttttccctttctctctctctttctttaatttctacttcactacattagaatttaactgtcattttggtaggatgtatgatttcaagctattaaggtgagctgtataacagggaaggtcaaaaccgtgaactgagtcctaaattatgtagcctaccccagtgacttacattgtactttccattgtatttatgcttggctttttaagcgaattttgtttatctgtacaaaagtattgtcacaatacaaaatagttgtaatatgccactttttgagtgtctagcaatgcatattaaaacaatagaactgtgagtctatataaatatgctaagagagttttcatactggctaaaatggcaacatcttgtcatgtgaagatacagttcatttgtgatcattatttttgtgtttgtgattgcattaaaatttttatttttaatgtgttaattgtatacatagctaatcattaagatctgtaagataaacataaaacttgtgaattttagtttcacttcaggataatttcacaaaccactagattattttcaaatgctgtgaagcttggaattgggagtgctcttaagttaatgcatcctcatgtactgtttaattcagtatatatattatcttaactttaagaaaacaacctcctatttaatacttaaatacaggcctgaaaatgagatctatatatgcaactaaagattattttaaatgatagataaatgtgtgtgcctatgaatggtgaaatgattgtgttacataattaccatacttttgatgatgtaccataaaatggctttgagaagacagctatgcttattttgacagaaaaaatatgtctttctagcaaatactctcgtattggcctttcatactcccacttttgtaaccttttctgagcatctgtaacattttactaacctagaaatatggtttatcttttttgggagaagatctgaaatagctttctcatacatcaatcaggatgtgagtgagctaattcttttgagttactcatcattattgttcttttaaaggtgggattctgacaaagttaatttaatttaaataagtttctaactgtgagataaatcttcccattttgaaacactgcatggtatttttgctttataaatagtatttcagtgtttatgccatagattaaggtgagttgggagtgaagtggaaacctttaccatactgtttgtttttggagattgaaaggaatatccatgtactaaataacatgtttcttgatttcagccaagttcaaaaactgcagaaatagataattttaaaatgataactatgtgtcattgttgttgttgttgttgttgttgttgttgttttgtgtgttgtttgtgtgcgtatgtattttctttttcattttaaccagcctcttatacctagaagtcccacaagcagcgttgccacgccttccagcaccatcagtacacccaccaaaagagacagttctgccctccaggatctctacattccccctcctcctgcagaaccatatattcccaggtataaaactatcacgttgtcctaggcagcttctagctaaaggtaaacctaacagcatataaactgcaaagtcaattctgaaggaacaccttgaatattttctcacagttaggaattctgaacacattctgcaaaatcattcccattatagagcatgcatgtttattaataataataataactaatttgtatataaatacttgctgtgcattaaataatttatactatctcataataggaaagaagaagaaagtaatattaaataataattaggattattttaataagtaaacaataagtgaggctgtttggctaaaaagccccagaaaatttcaggttactttgaagcatttcatacattttttttttaaaaaaagagaaagctatagataacttttatgctttcttaaatgtaagtaatgaggaagattttatttggtaatgatgatgagggagaatgtctttttcccctaataatcctgtgtctgaaatttttatttcattaattcattaatgtttctttcaggaagtagagtttacaagggaatgaattacccttaaagtctattttctagatttcttgaggctgtatctctatttcatttatcgattcttatttgaaaatccttgcagatgtggaagaatacagctttatgtcataatgcattcttcctaaaagcattctgatatccagccttgtgaaatacaaaaattatggaaaaggactagcactaaatggggatcattaataccaatcacaaaaaaacttgattcagtttttaaattagttctgcattcaaaaacaataatttaaggtctcttgttttcaagccataaatagtattaaatttctttcatatataaaagaactaaattccttgtgtttaatttccattattctttagtacacttagtgtttcagaaatctgtattctattagatatgatggtttactgacattatgtgatctaaatgctgcatggcaatatggtttatctgcaaatactgtgttgtcatctagtaatataactatagttagttttatatatattttagttctttgagaattaaatatagccattggaacataacttataagatatagtttactaagctggcatttcataaatctaatatataatttacagtcttgtgttcaatttacaagcaaatatacaaatccatccaatatcctactaaaatgctagttgcattttaattctgttaagacagtgtcagattttccacatatgcttgcatgaggaacaatgaaagtatgtgtgttccaaacaggaagtgactttttatgatttgtttacattttatttggaaagatttttatttcagagcaaataattatttaaaaggccttattcttcagagggctacatacacagataaacattaaaagattatttttatcaaatctctgtagttttaaaatgttctttcctcttgggtagtgaggaacttgttacaaagaaagtgtctcctctacagaaaatatttaaaatacacttaagaggacaaaagagtaaaatgatccagttttgtcttctgagtgtggtggacatattataaaggctatatattgaagccaataaaaagcttgaagatgctatttaaaaatattagagaatgtgaaattgaaatatcaacatagtgacccttgttttgtcagtattgcttgaaaactccatacttttctgtaaaattcatagtgtttactatatcactgcaactgattcttagttggtcagtgtataatttaacagaatattctaaatacattttgagtcaaattattacttacccagtcataaagtctttcgatattggagtcaggacaatccatgcatcaaagcccctttgaaccacagccttatataaatgtctgcattttctggcttgattttaagttgacagtcaaaactttttgcagtcgtgattatttttacagatacagccttggcacttttttcctattttcttattttgaagatgaatgtgatggacttagtttaattcctctgaacatttttccccatattaaaaaactttgtttatacaggataggcattttggtggtatgtgaacatatatgtttgatttggatggcaaataataaaacctctctcatctcaaaaagaaaacagacttgaaaaatgataggactagttttcaaattaggcagaatttttttcatgtggttatgattttttgaacacatttaatccagaaaaaaagttattgcaaaagtgcctttttctctaaaagataaaacactcatgtatgtgaagtgagtgaaatttggttggcattttattatatgtcttgtgactaaacacagtttcattatcattatatatagtacatttctgtacttaaccaaatttctttttctatgataaaaatgtagaatttataggtctttgaacaactatgacatttaagtactaatttctcctattaactctactgtgtgccattaaatataaagttagttcagtaaagcaatgctcttttaatgcttccttaaatcctttctagagcaaaggcacagatttattacttacgtgcattaacttacaatattaagaaaggtgtaaaaactctttacatcagaatgaattaacacactgagttctccagggactcatgacgtgaatatatacattaacacacacacacacatacacatacacacatttacatacacaatacatgtatctactcattctactgaaaagtttggttttgcttggtacttttcttaattcaacagtattttactgcattctatatagatttgttttaaaaatctaccctgttgatataaggtccctccttcatattattataggaaataccatccctttcaatttcctgccacaagatgtttccatataaatatagtatgtgtattaatagggctgaatcaccctctgatttcagctgcattaacattcatgtcacaagcctcatagcttgaggtctggtacattgacagatacgcataaccttactccagtgccacaaattcgttaaggctgcttccaagctagttgcagtctcaatttctttttgatagtggactaaccaggcaatttgttcaggaaaagttttcagcaagctgaaagaaaattctgcctggattttatatttatttccttcatgttgcctaagaactatctatatagttctattgtggtaataagcaatacttttattttagaaaataaaagagtaaattgtaatgtaaatggcaacaacaccttgtgatgggttaaacagataagaaaactcactgattgtcagtctggagaatgttgtttactactttctacatatttcaaatactgggaatatagttttctacatttggacaaacctaaacatttacacacagaagcagaaatacaggcttttgccagactggggctcatattttagaattcacattacttttataagctcatcaccattttataaggtataataggaattaattaaaaatttgttctttttatctgtcttgttataatttagtttattctatgaatttaagattttagtctcatcacttaacataaaattaaattgtttttctggtttgacagcatttattcatggcactgtttagggtaaccagaaacaattaagaacaaggaagaaatttaactaatggtccacaaggggggaaacattgcatttacattcatagtcatgttctagaagacaagcttttctgacaaaaagttcataggtaagcagtgaaacatgtcataaaataaacaagattcaatttaacaaatcacaaatggactatttctatcaaaatgggcttaatctgggcttaattacctattgcagtgtgtgagtaataggttttagggagcccataaattattagagatgtttttctctagaatcctatagaagaaaaaaatcaacttgccatcaccctaaatgccattcttaaactctatattttatcagattaccttctctcctcaagaaacattgatgtataatgaaattttgatatatccatttagaatgagttctaggaatatgtctttttactcttaaatgagatacgtagagtttgaatactgagaataattcttttaaggtttattttaaattaataacatgttgtttgaatttcttataatacaagtttatatcatgctaatttgattcctaaggctgcagtgctccttatggtagttcttaaatatatttctatttttaagcagtgcagatttttaccaagaatcaatcaggtaaactggcagaagaaaacattatacttaagttaacattactaccattatacctactgtcttgaacactaaaaacaatttatgtgctaaggtaaactggcagaagaaagcattatacttaagttaacattattaccattatacctactgtcttaaacactaaaagcaatttatgtgcaaaggtaaactggcagaagaaagctatatacttaagttaacattactaacattatacctactctcttgaacactaaaagcaatttatgtatgacatggtacagtgaaaaatggacttgggcaacagttaaaagtttcatggcctatttcaaattctgtcagttattagctgtgtaacattgaggcaagttgtttagcctttctgagactcaccattttgttttcagcaaaataagaataattacaaattgccctgtaaatctcaaagaaagtttgaaaaggtcaggagatatattgtatgggagtaaattattagtattttagaccctcggccatttactaccctaacatgtttctacatcttctcctttactctaacctttctttagggatgaaaaaggaaaccttccttgtgaagacctcagaggacatatggtgggcaagccagtgcataagggatctgaatcaccaaattcatttctggatcaggaatatcgaaagagatttaatattgtcgaagaagatactgtcttatattgctatgaatatgaaaaaggaagatcaagtagtcaaggaagacgagaaagcaccccaacttatggtaagagttcttcttttatgtttatataagactatatttctggcataggaatctcaatttcctttaataagtttttgggttgtgagagttacttaggcgcttttgaatctttataattgatctgtctctctcatgtgcttctaagtggaatttctacaatatgagacattatattaaaaattattctagattttcaaaagataagaaagaacagtaggtaacattgtagctcataatgatttataaaaatctttttagcatcacatgtatttcttgtgtgttagatgttgccagtttggaaaaattcaagtgtttttttattcttttttgtttttttaaatgaatacttactgttaacatgacttatttaaaataaaattatctccatattcctcagggattttaagaaatataattttctcgagaaattctcacctcagtttttgtattttttaaagaagctgtgaaatttatttgacattagagtggaagtggattttaaatagaatggattgaacatactgtatttaaggcaaaaatgggcttagagttatgatgggcacaggattgttttaatctttgattcatgaccgaaaaagtaacccagtcacaaatacttaaaattgttatagtatatctgaaagatttgcagataaagttgcttaaagtagtcaagcttgtggttcttctgcaagaataaatggatttaattgaaagtctctgctcctccctttccacttttcaaattaataatttttagcgaggagcttatactttgaggaaggacagcatccctgctaattagttcaaacttgatcaatgggagctgagcagaagcaaagttgtttttagctcctccattctattcctacacctcacttgtctgtcatggccatatgcctccctcctttggtctcaaaagagcagtcatcacatatcttcatatacatgtcttatttcctttcagctctttggtaataagtatgaaagaaaaattttccccaaaatgatgctaaagaataggaaccatacttatcttaccttgtgttattctctgtacatgtgctttttaatcataagaataaataatatattttaacataaactcctcaactacactactctagtggcaattaaactgttaagtattgaagatatttgaacctttacttttctcctctactatattgtaaacctacaatatagagtatagaggcctgtaatctttgctatccctacccttgccccatgaaataatatgaaattttttttcttattcattcattccacaagtactaattgactgcctattaccaaataggcagtaatgtatgtcaactcttctttctttgtgtcccagtattatctggctattttctacttgtgttgaagtagataattaatgtttaatttaagagaaattatagtcaccaaatgaaagtgattgattactgatgactttattttaaaaaatgtttactaagttcttactcgaatggctataaattggtagtcccttcggactacattttaaagcccctaatgccatcatgtgccacaaatctcccccgactagaatagaatactttttaaatattagaaaatttagatagcctataaatacttgacatctttttgtaaccaacttaggagaaaagaaatatgtacatacttaaaagagagaagtaagcagagttatttgtttcattcagtatggcttttaactttctaaaattgacacataataattgtacatatttatgggatacagagtgatattttgatacatatatagaatgggtaatgatcaaatcagggtaattagcatattcttcaccttaaacatttatcacttctttgttctgggaacattcgaaatcttctcttccagctgttagaaattatataataaattattgttacctatagccatcctatagcaccgtagaataccagaacttaacttctctcatgtagctgtaatttatatccattaaccaatctcttcaaaatccctctcccactcacccctcccattctcagcctccagtaaccacagttctactctctatgagctcaaagtttttagttcccactcgtgaatgcaaacatgcagtatttatctttctgggcctgatgtattttacttaacataatgtcttccaggttcattcatgttgcagcaaatgataagatttcattcttttttagagctgagtaatattctgatatatatatatatcacattttctttatccattaatctgttgataaacacataggttaattttaatatcttagctattgtgaataatgctgcaatacacatgggagtacagatatctctttgacatactgatttcctttcctttggacctatacccagtaatgtgaatgctgaatcgtatggtagtcctgtttttagttttttaaagactctccatactaattactataatgacggtaccaatttacattctcatcaatattgtataagagctcccttttctctgaatcattgccagcatttcttattttttgtctttttgttaataaccattctaattggggtgagatgatatctctttgtggttttaatttgcatttccctaatgataaacgacgttaagcatttttatatagcagttggtcatttgtgtgtctgctttcacgcaatgtctattcagatcatttgcccatttttaaataaaaatatttcttttattgctgttgagttgtttgagttccttgcatattctggatattagttccctgtcagatgaattgtttcctttgctctacataagacttttagtttgatataatcccgtttgtctgttttttttcttttgttgcatgtaaaccttagccataaaaatatttgcctagaccaatgtcctgaagtatttcccctgtgtattcttctagtagttttataatttggggtcttatatttaagcgtttaatccattttgagttgattgtgtacatggtgagagatagggttctagtttcatttttctgaatatggatatccagttttcccagccctatttattgaagaggctatcctttgcccaatgtatgttcttgttgcctttgtcaaaaatcacccggctgtaaatacggacttatttctgaatactccattctgtttgattgggctgtgtgtctgtttttataccagtgcaatgctgatttggttattacagctttgtagtgtaatttgaagtcagtcagtgtgatgccttcagctttgttctttttgttcacaaatgctttggctatttggggtattttatggttccatacaaattttggattttttttctatttctgtaaagcatgtcattggtattttgacagggattccattgaatctgtagattgctttgggtagtatagtcattttgacaatgttaattcttctaatccatgaaaatgtgatgtctttccattttttgtgttctcttcagtttctttcatcagtgttttgtagttttcattgtagagatctttcacttccttggttaactttatttctaagtattttttgtagctattataaaggggattgcattcttgattttttttcagatagtttgttattggcatatagaaacactactgatttttgtatgttgattttgtatactgcaactttattgaagttcttaatcagttctaagagttttattgtggagtctttaggtttttctatatataagaacatattgtctgcaaacaggaacaatttgactttctcttttccaatttgaatgccctttatttctttatcttatctaatttctctggttagcatttccagtactatgttaaataggagttgtgaaagtgctcatccttgtcttgttccagtttttagagaaaaagctttccacttttctccattcaatataatgttagctgtgggattgtcatatctggcctttattgtgttgaggtgcattgctttctaatttgttgagagtttttatcatgaagggatgttgaatgttattaagtggcttttttgtgtatctattgaaatgtttatatggtttttgtcctttattctgttgaggtatcacatttattgatttgcatatgttgaaccatccttgcatctctgggttaaatctcatttgataatggtatacaatcttttttatgtattgttagattttattttctagtgttttgttgaggatttttgcatccatattcatgagggatattggtctgtagttttcttttttagttttcttcttgttggattttagtagtaggctactgctggcctcatagaatgagtttggaagaatttcctcctctactattttttcggatagtttgagaatacttggtataagttattctttaaaagtttggtagaattcagcaatgaagccagcaatgaagtcatctggtcctgggcttttctgtgttgggatcatttttattactgattcaatctcattactagatagtgatctgttcagtttttttatttctccttgattcaatcttgatacattatatgagtccaggaatttatcattttctctaggttttctaatttgttggcttgtagttgttcagaatagtctcttatattcctttgtattattgtggtatcagtggcaaagtttcctttttatgtctgactttatttgggtaatctctgttcttagtctggctaataatttattttgtttacccttcaaaaaatcaacttttcgttttgttggtcttctgtaggttttttttttttttgtctctttcatttagttctgctctgatctttattatttcttttcttccactaattttgagtttgatttatttttgcttttctgatttctttttttcctaattttttgaagtgcaatgttggagtgtttatttgaaatctttctgcttttttgatgtaggcatttcttgctataaacttctttcttagtattgcttttgctgtatcccataggtttttgtatattgtatttctgttttaatttgcttaaattttttaatttcctttttaatttcttcattgacccattcgttgttcagaagcatattgtttaacttccatataatcgtacagtttttaaagtttctcttactattgatttctagttttatttcattatgatctgaaaagatacttgatagaatttcaatttttaaaatttgttgaaacttgtggcctaacgtatggtctatcctggagaatgttatttgtactgatgagaagaatgtatactctgcagctgttgaatgaaatgttctgtaaatgtctgttaggtccatttagtctatagtgcagtttaagtctgacatttctgtgttgattatctctctagatgacctatctaatgctgagagttgggtgttaagtccatagctattattatataggggtctatctctccctttagctctagtaaggtttgctttatatttctgggtgctcctgtgttgggtacatatatatttacaactattatattcatttgctgaattgattcctttgtcattatataatgaccttctttttacagtttttgacttaaagtttattttatctaagtatacctactgatgcttgatttggtttttgtttgcatgaaatatctttttctgtctttttactgtcagtcggtatgtgtctacaggtgaagtgagcttcttgtatgcagtatagagttgggtcttgttttttttttttttttctttaatccactcagccagtctatatcttttgattggggaatttaaaccatttacattcagggttgttactgataggtgaggaattactccttcatttaggcaattgttttgcttattctttgttgctttcttctctttttgttttatctttgcagtttggtggttttctgtagtgataaggtttgattcatttatctttgtcatttgtgtttctactctaccagtgacttttattcttttgtgtgcttccatgatggaaattactgtctttttgcttatagatgtaggattcccttaagtatttcttttaggcctggtctagtggtaatgaattccctcagtcttttcttgtctgggaaagactttatttctccttcattgctgaatcatggctttgctcgttgtagtagtattagccaacaatttttttctttcagcactttgagtatatcatcccattctttcttggtctgtaaagtttctgctgagaaatccactgttattctgatggaggttctttttatgtgatctgacacttttttcttactgtttttaaatttttttctgtgtctttgacttttgacaatttgaatataatgtgatttggagaagacttttttgggtttgaatctgtttgcggttctttgagcttcctgtatgtttgtatggtatatcgcttgcaaaacttgggaagtttttagctcttattttgttaaatagtgtattagtcagggttctccagagggacagaactaataggatatatgtatatatgaaagggagtttatgaagcagaattgactcacacgatcaccaggtgaactcccacaataggctgtctgcaagctgaggagtaaggaagccagtagtggctcagtccaggtcccaaagcctcaaaagtggagaagccaacagtgcggacttcagtatgtggccgaaggcctgagagccactggcaaaccgctgataaaagttcaagaatccaaaggctgaagaacctggagtctgattcaagggcaggaaccatctagcatgggagaaagatgaaagccgaaagactcagcaagccagcttattccacctccttctgcctgctgtttctagccatgctgacagccagttggatggtgccacccacattgagggtgggtcttcttctcccagttcactgactcaaatattaatctcctttggcaacatcctaacagacataccttgaaacaacactttgaatccttcaatccaatcaaattgacacttaatattaactattacaaataggttttctatgcctttgcccatttaatttacttctggaacacttaaattcaaatgtttggtcactttatggtgtcccatttgtcatgtagagtttctttattcttttttattcttttttctttcttttatctctgactggattatttcaaaagacctgtctttatattcagaaattccttcttaagcttgatctagtctattgttgaagttctcagttgtatgtttttatttcattcattgaattcttcagttttaagatttttgtttggttcttttatatgatatctatttttgttgaatttctcattcagatcatgaattgtgttccttattttgttgaattgtctgtattttcttatatctctctgagtttccttaagatcattattttgaattgcttttcaggcatttcatacagtttttttttcctttggtgtatattgctagagttgtgttcctttggaagtgtcatatttccttactttttcatgtttctcatgaccttacattgatatctgtgcatctggtgaagcagtcacttctttgaattttgtgggtttgctttcacagggaaagacatttttctgcatttgcattctatagtgtcaattgggtagggtgctttgtttgggttgtgtgtgtgtgcacagtagtgtaatctccatatgatatctttgtctatagtcactcttgtattctccaaagttttttttttaacttttgaaactgaaacaaatataaccttaatgtagatacttgtagatacttcactggagattcctcagtacaagaactgaagattgtttcaagtaaataacagtttaatgtatttacctttttaaaattaaatgttaaataataaaacctatatgtcaggcacaggactgtgtggccctaattttcccaacaatttatttgttaagtcattcaactaatacttgtatacataaagtcagccagccactgggacacaaaaatgaataaaaccataaatcctaattacccaaagggaagaaacaaataaatagatgcatcacagtcacttcaggtaagttggaaggtgtgcaccaagtgctgtagtagcctaggaaataaagtctcatagtttgccttggaagtcaaatgagtacacatgacatttatgctgggttttaaatgatgaatagcgatttcatccagggtttttaaatgctagtcatcccaccaaatacctggtaccttctcaagcctatgtctgagatctgaagatttgtctaaatatctcagcccagaccctaacgaccccaacagaaataacttcaaaccttcataagcaataatcaatgacaacttttttatttaacctataaaatagtcccattacctggactcccaagtgcgacaatattatcttgtatttgaaaataatgataacgaaagtatgtaatcctgcttaaatatattgtttaaaaaaaaactaaagtacaaaaaactacatacttgacattttctggaaataatggtaatttaatctcttagcacttgtgtgataccttaaaatgcactatgtaagtcttttatccttagagtgttcaatttctgttcttggtcacaaaaacccttaccttgaagtatgtgaatttagctaccacttctttcctattaacttcccagatcatctgtttactcaaagagactttagagttaagattataagaatatgggtaggattttgagaagcaaaagcgatatgacacagttcttcatatgtgctttcagttgaatgtgtatgtagttgctatattttccttgtacattcatattctaaatttagacatctaatagaaaaatagggacactctgttattaaacacagtgacaaagaaacacagatgtaaagaaaaatatttgaaaatatctggttgttttttttttttgagatggagtcttgctctgttgcccaggctggagtgcagtggcacgatctcggctcactgcaacctccacttcccgggttcaagcgattctcctgcctcagccttccaagtaggtgggactacagatgcacgccaccacgcccagctaatttttgtatttttagtagagacgtggtttcaccgtgttggccaggatggtctcgatctcttgacctcgtgatctgcccacctcagcctcccaaggtgctgggattacaggcatgagccaccacgcccggcctgaaaatatcttaatagtagcttttaaagtatgttatttaacgaagattcttatgttataccatggaccctctagttgttaagaatgagttaaaagaagtacaggtatttaccctaagcaattaaacaaatacagtatggactgacagtagatggcatttctagaaaataagtaaatacaataagccctcatttaacatcatctacaggttcttggaaactgggactttaagcaaaatgatgcacagctgatcccaatgccatttccttcaatatcattttgttataacaatgaggaagaagatggttttgtaatctgtggtttcactttaagtcccagtttccaagaacctagagacaacattaagtgaggacttactgtaatacctgttgagcgttcaggtatgccaaacacagttctaagcatttaaaagcattaatctatttaatcctcacaacaactctatgaggtatgtactaataaaatatttgttttacagatgagaaatctaaaaaacagaaaggttaaataacttacccaactagtaagtgatagagctaggattaagtactcatggatatttttttgacccttaccagtggtaatgctagctaaatgtgatgaaaataattttttaattgtaggtaaataatttccaaaaattacattcctcgttctaaattcaagaatttgattccagcaagcagaaccaagtctgattttatatgttcttgtgtatgttgttttggatttactaacactataacgagcatgcatttacatagatatgaacctgacaggccttaggaaaagactgctaaatttagatgtaaaatgagcaacaatgtgttatgtcctttttaaatcagagagtataaaataggtttactttcctaaaaagatagacaggaataacttatggaaacatggataccagtagcagaagcaatctagattagtagttactagcattggctgtagcatcagccatagttggtaattttgtctgccatctaattattccagtgtgaccttggggatgttactctgggcctcagttttcttattaaatgaatatgataatatctgccttgtagagttttgtgagatttaatggtaagacattgtaaattgcctcagtgcccagtatgttgggtctttgttttcattattatcattattacatagaagctttaacatggaaatagaaacagggaaaaggtggcattaaatcattttaactatatagggtctcattgctcaggcttcaaaggcaaaggcttaaatttgatgagatcagttgcttggcaacttttcaaaatggtaatatttcccatcagcttttccatcttgctgtacatggactccttgcccttgctatttcatcataacacatttctatgcatagaaacatgctaaaaggtagacacagttggctgagtccctttgtggccatgaatggtcatattttataagaataggaggaaaacatatcttttaacaataatatcaccaaatagtattggtttgaaggtaggaatccagaccttttctgatttattgaaaatccaggacctcacaaaaagcacaggaatgaatgtaaagctgatattttagaaattatcctcataaatgttacttgtacacattgtgcattgaggaaaattaatctctgtaacattatacctgaacattttctacctgagtagttgggacaagagaaaatcaaatactatgtcctttttatccacataaatagcaaacggcttgagtgacatatagcagtatgatgaagggcctatgggcaatgacatcataaactgagttttatcaatgtgaagttaggatagcgtctgtaggttccagggtctctctgtcctgtgattttaaaatgtaaataatcttccttatcaggtaaaagttcagctgtcattaatcagctattctggagacaaaagaaaataggattctacccatgggaaatttttgtgttcaagtaaaatgtacgatttccaaagaagaactaaccacagaaatagaaattagtgattcaaagatgaagaaatgtgggatgtgcactatattcatgggaattcttattcctttagacttatttaataaagttcataaagactacatgttggttagcctcacaaaataatttttagcatcaagctgatggtggtaaggaaccatgtaattgatggaaaagcagttcaacaatattttgacatagaaagtagtctgtttctattgtaaaacttggagaaatcgtctaaggaaggcattcttcctgaatttgtgcaattttactgatggaaatggaagagcatgaattatgaggtcaaatagacttgaatttgctatcacagcttggcttttaatagctaattgaccttgagcttcagacttaacctccctgtatttttgtttccctgtctgtaaaatggaatagtaatattactcatggtgtttttttatgaggattaaattagataacatacgtcaaatacttagaagagttcttttttttcttttcttttctttttttcttttttttgagacagggtcttgccctgttacccagtctgtagtgcaatggcatgatctcggctcactgcaacctccacctctcgggttcaagcaattctctgcctcagcctcctgagtagctgggattacaggcgtgcatcaccacgcctggctaattagcagagttcttgcctcatagaaagtactcaagaaatgatgccttagatggtataataaatgcttgctgctcataaataaaaatgtcccaaagatttttcaagtctcctgtggaaggacttagttagtaaaggacaaagtatctagaagtctttccacatgtttggtcactctaccaagccaatagctggccatttaaattatagcagttaaatatgagtagagctttttggtttcttttggtttgattttgcaaaccaaagcagaaggaagatctttcaaatagttaataacactgcaaactgccctcatccaaatcctcttaagctccagtataaaaatcatcagctcacatgctggattagaagggcccagttataatctctcagcgtcaggaatctgaaaacagttcagcccccacatctttttaaagtttttgattagttgcttaaaaaatggaagaatagtatattatataaaataaataaaatggttggagagccttaaagaaattaaacctaggaagaaaagattattctgaaagaattcaaggtactaggtaatggataaaacagtaagattaagaaaaagaactttcggtggctggcaagatggccaaataggaacagctccagtctgcagctcccagagggatcaatgcagaaggtgggtaatttctgcatttccaactgaggtacctggctcatctcactgggactggttagacagtgggtacagcccgtggagggtgagcagaagcagggtggggcgtcgcctcaccctggaagcacaaggggtcggggacctccctcccctagccaagggaagccatgagggactatgccatgaggaacggtgcattccggcccagatactacgcttttcccatggtcttcgcaacccacagactatgagattccctcaggtgcctacaccaccagggccctgggtttcaagcacaaaactgggcgactgtttgggcagacaccaagctagctgcaggagttttttcctaccccattgacacctggaatgccagcgagacagaaccattcactccctggaaagggggctgaagccagggagccaagggatctagctcagtggatcccaccccgacagagcccagcaagttaagatccactggcttgaaattctcactgccagcacggcagtctgaagtggacctgggatgctcaaccttgctgggggaaggggcgtccaccattactgaggctttagtgggcagttttcccctcacagtgtaaacaaagcctctgggaaattcgaactgggcggagcccaccacaacctcggcaaagccacggtagccagactgcctagattctcctctagattcttctagtttcttcctctagattcttcctctctgggcagggcatctctgaaagaaaggcagcagccccagtcaggggctcatagatagaactcccatctccctgggacagagcacgtgggggaaggggtggctgtgggtgcagcttcggcagacttaaacattcctgtctgccagctctgaagagagcagcagatctcccagcacagcgctcgagctcagctaagggacagactgcctccttaagtgggtccctgacccccatgcctccttattgggagacacctcccagcaggggttgacagacacctcatacaggagagctccagctggcatctggcaggtgcccctctgggatgaagcttccagaggaaggaacaggcagcaatctttgctgttctgcagcctctgctggtgatgatacccaggcaaacagggtctggagtggacctccagcaaactccagcagacctgcaccagagggacctgactgttagaaggaaaactaacaaacagaaaggaatagcatcaacatcaacaaaaaggacatccacacaaaaacctcatccaaaggtcaccaacatcaaagatcaaaatagataaatccacgaagatgaagaaaaaccagcacaaaaggctgaaaattccaaaaaccagaatgcctcttttcttccagaggatcacaactcctcaccagcaagggaacaaaactggacggaaaatgagtttgacaagttgacagaagtaagcttcagaagatgggtaataacaaactcctgagctaaaagagcatgttctaacccaatgcaaggaagctgagaaccttgaaaaaaggttagaggaattgctaactagaataaccaatttagaaaagaacataaatgacctgatggagctgaaaaacacaacatgagaacttcgtgaagcatacacaagtatcagtagcagaatctatcaagcagaagaaaggatatcagagattgaagatcaacttaatgaaataaagcgtgaagacaagattagagacaaaagaatgaaaaagaatgaacaaaggctccaagaaatatgagactatgtgaaaagaccaaacccacatttggtcttgtttggtgtacctgaaagtgactgggagaatggaaccaagttggaaaacactcttcaggatattatccaggagaacttacccaacctagcaagacaggccaaattcaaattcaggaaatacggagaaaaccacaaagatactcctcaagaaaagcaacgccaggacacataatcatcagatttaccaagtttgaaatgaaggaaaaaaaggttaagggcagccagagagaaaggtcgggttacccacaaaggaaagccaatcagactaacagcagatctatctgcagaaaccctacaagccagaagagagtggggggcaacattcaacattcttaaagaaaagaattttcaacccagaatttcatattcagccaaactaagattcataagctaaggagaaataaaatcctttacagacaagtaaatgctgagagattttgtcactaccaggcctgccttacaagagctcctgaaggaaacactaaatatggaaaagaaaaactggcaccagccactgcaataatatacaaattgtaaagaccatcaacactatgaagaaactgcatcaactaatgggcaaaataaccagctagcatcataatgacagaatcaaattctcacataacaatattaaccttaaatgtaaacagactaaatgccccaattaaaagacacagactggcaaattggataaagagtcaagacccgtcagtgtagtatactcaggagacccatctgacatgcaaagacacacatgggttcaaaataaagggatggaggaatatttaccaagcaaatggaaagcaagaaaaaaaaagcaggagttgcaatcctagtctctgataaaacagactttaaagcaacaaagatcaaaaaagacaagggcattgcacaatggtaaagggatcaatgcaacaagaagagctaactatcctaaatatatatgcacccaatacaggagcacccagattcataaagcaagtcctgagtgacctacaaagagacttagactcccacacaataataatgggagactttaacaccccactgtcaatattagacagatcaatgagacagaaaattaacaaggatatttaggacttgaactcagctctggaccaagcagacctaatagacatctacagaactctccaccccaaatcaacagaatatactttcttctcagcaccacatcacacttattctaaaactgaccacataattggaagtaaaacactcctcagcaaatgcaagagaacagaaattataacaaacagtctctcagaccacagtgcgatcaaattagaactcaggattaagaaactcactaaaactgcacaacaacatggaaactgaacaacctgctcctgaatgactactgggtaaataatgaaattaaggcagaaataaataagttctttgaaaccaatgagaacaaacacacaacgtaccagaatctctgggacacatttaaagcagtgtgtagagggaaatttatagcactaaatgcccacaggagaaaatgggaaagatctaaaatcgacaccctaacatgacaattaaaagaactagtgaagcaagagcaaacacattcaaaagctagcagaagtcaagaaataactaagatcagagcagaactgaaggagagacatgaaaaacccttcaaagaatcagtgaatccaagaggtggttttttgaaaagattaacaaaataaaccactagccagactaataaggaaaaaataaagaagaatcaaatagacacaataaaaaatgatgaaggagagatcaccactgatcccacagaaatacacactaccatcagagaatactatcaacacatttacacaattaaactagaaaatctagaagaaatgggtaaattcctggagacatgacaccctcccaagactaaacaaggaagaagctgactccctaaatagaccaataacaagttctgaaattgaggcagtaattaatagcctatcaaccaaaaaaagcccaggaccagatggattcatagccgaattctacctgaggtacaaagaggagctggtaccattccttctgaaagtatcccatacaatagaaaaagagggactcctccctaactcatttcatgaggccagcatcatcctgataccaaaacctggcagagacacaacaaaaaaagaaaatttcaggccagtatccctggtgaacatctatgtgaaaatcctcaataaaatactggcaaaccaaatccagcagcacatctaaaagcttatccaccacgatcaagtcggcttcatccctgggatgcaaggcttgttcaacatacccaaatcaataaacgtaatccatcacagaaacagaaccaatgacaaaaacctcatgattttctcaatagatgcagaaaaggcctccagtaaaattcagcaccccttcatgctaaaaactctgaataaaataggtattgatggaacgtatctcaaaataataagagctatttatgacaaacccacagccaatatcatactgaatgggcaaaagctggaagcattccctttgaaaactgacataagacaaggatgccctctctcaccactcctattcagcatagtattggaagttctggccagggccatcaggcaagagaaagaaataatgggtattcaaataggaagagaagaagtcaatttgtccctgtttgcagatgacatgattgtatatttagaaaaccccatcgtctcagtccaaaattgccttaagctgagaagcaacttcagcaaagtctcaggatacaaaatcaatgtgcaaaaatcgcaagcgttcctatacacccataatagagagccaaaccatgagtgggctcccgttcacaattgctactaagagaataaaatacctaggaatacaacttacaagggatgtgaaggacctcttcaaggagaactacaaaccactgctcaaggaaatcaaagaggacacaaacaaatggaaagacattccatgctcatggataagaagaatcaatatcatgaaaatggccatactgcccaaagtaatttatagattaaatgctatccccatcaagctaccattgactttcttcacagaattagaaaaaaactactttagatgtcatacggaaccaaaaaagagcccatatacccaggacaatcctaagcaaaaagaacaaagctggaggcatcacactacctgacttcaaactatactacaaggttacagtaaccaaaacagcatttactggtatcaaaacagatatatagaccagtggaacagaatagagggaggcctcagaaataaggccacacatctacaaccatgtgatctttgacaagcctgacaaaaacaagcaatggggaaaggatttcctatttaataaatggtgctgtgaaaactggctagccatatgcagaaaactgaaactggaccccttccttacaccttatagaaaaattaactcaagatggattaaacacttaaacgtaagacctaaaaccataaaaaccctagaagaaaacctaggcagtaccattcaggacataggcatgggtaaaggcttcatgactaaaacaccaaaagcaatggcaacaaaagccaaaatagacaaatgggatctaattgaactaaagagcttctgacaggaaaagaaactatcatcagagtgaacagtcaacctacagaatgggagaaaatttttgcaatctatccatctgacaaagggctaatatccagaatctacaagaaacttaattaaacaaatgtacaagaaaacagccccatcaaaaagtgggcaaaggatatgaacagacacttctcaaaagaagacatttatgtggccgacaaacatatgaaaaaaaagctcatcatcactggtcattagagaaatacaaatcaaaaccacagtgagataccatctcatgccagttagaatggcgatcattaaaaagtcaggaaacaacagatgctggagaggatgtggagaaataggaacactttgacactgttggtgggcctgtaaattagttcaaccattgtggaagacagtgtggcaattcctcaaggatctagaaccagaaatagcatttgacccagcaatcccattactgggtatatacccaaaggataataaatcattcttttataaagacacatgcacacgtatgtttattgcagcactatgcccaatagcaaagacttggaaccaacccaaatgcccatcaatgatagactggataaagaaaatgtggcacatacacatcatggaatactatgcaaccataaaaaaggatgagtttgccgggcacaggggctcacgcctgtaatcacagtactttgggaggcagaggcgggtggattgcttgagctcaggagttggagaccagcctgggcaacatggtgaaccctgtctctactaaaaatacagaaaattagccaggtgtggcaggatgtgcctgtaatcccagttgcttgggagactgagacgggagaatcacttcaacctgggaagcggagattgcagtgagccgagaccgttgcactccagcctgggcaacagagcaagactccatctcaaaaaaaaaaaaaaatgagtttatgtcctttgcagggacatggataaagctggaaaccatcattctcagcaaactaacacaggaacagaaaaccaaacaccgcaggttctcattcataagtgggagttgaacaatgaaaacacatggacacagggaggggaacatcacacaccggggcctttcgggggttgggggactaggggaaggatagcattaggagaaatacctaatgtagatgatgggttgatgggtgcagcaaaccaccatggcacgtgcatacctatgtaacaaacctgtgcattctgcacatgtatcccaaaacttaaagtataatttaagagaaagaaagaaaaatcacttttaataaagttcggtggtattcatatgtagataaaatagaagtattagcaaaccaaatcaacatagctgatgcaactatgaggggggaaaaaaacctcttcagatgaattaatcgaaaagatatgaactagatgaaatagtgttcccttataaacagaatgggaaagccaagaagagaaacagtctcactcagtgattctctgggttcagtattgtcccccaggggacatttggtaatttccggggacaattttgttgtcacatttgtggtggaaagttgctactggcatctaatgggtagagaccaaagatgctactaaacatcctgcagtgctcaggacagcacccaacaagaatgatctggcctgaaatgtctgagaaaccctggctaacttaagaatcaatttacaaataaattgaatacagaagcagatactagaaaatcaaagtcagagaccttgtatggcacagaggtgattgccttatatttttttaattgaaagaacctgggaagttactgccctggaaagatataccaacatttattcacagttagtatattctctggacagaagtattcatttaaggttgttagcgtcagggattacctagcctgttctacaatagataatctaatcatgacatcccctggagcaggagacaatacgtttatccctagtcgaaatccgaatacattttcccccatgagaaaaaaaaaaaaaactataataaatggtagctaggtaaagtttaaatagggctattcatgttagctttcagatcacaatatgacttaagtaatccagcgatttcctaagtacgttcttcagatcactagttctgaaagatagcctatggaagaaagaggttatatggttaaataagattgggaagttttacatattttaggcccctcttggagattaataaattcacattcacatactacatctttgaaagttttgttgaatttgggttaatttactgtttcccaaatgtgtttgtatattaaatcccttttttggtcacataatacttaccagcttcccaatggaactaatgttttatggaatgtattttggaaaatattgtaaaagacttttgcagctcttcttaaagacccaactaccaatgatacgatttctttgtgtcttaagttccaaacagctgacttacagataagcatatagaacaacctctgttctcaatatttaagcctgcccagcggttggattattgaatgtcatcttcattcttcattcttatcttgtagaaaagccatatgtaaactactttctagagtaaatcttatttatgatgaaagttcaaactaaagtaagaaaaactatctagaaagatcattacatggtgttctatacttcaagccacttgtggaattactactatcactgcaaaacaatttgccagaagtcatggaagaaatagatccttggggatagaaaatgtcaggtgtaatattcagtgttcaaaaagagataagtaaaaattacacactgaataatgactggagacattagagcaaataattaaaacagtatacagccatttaaaaatgtacatatgacaacttagcattgttttataagcaacacatcatgtcataccaatttatttgccatcattgttaaggtattggaccacaaacaaaaagttgcatccacagtttatgctgtaatcctccactagttcttcacatagccttagtattttgcaagagttgcaaactggctgtgaggacacttaaacaaacaaaaaaaaactaatcatacatgccattaaatttttgaagaaaaattaattggatttttgtctaatgtaatggtcttgaatgatacatcactgaggcaatttgatgtagtgaaaagaggtctgggataggaacttgaaagtctgtattcatggactgactctaagtgtttattaccctgaaacttctttagttttttttcactgaatatctgtgaaatcagattatctgtgaaatcagggagaggatgagggtgaagagtattaacctgtgtgctgtacttttacactccattgtcttctaattgtcttatttttgttctgtgaatgtgtccattagggtcctacattgtcaataaaagtgatgtttccattacaaaaaaaaaaaaactttggtctgtctgaagtttttcatctctacctttcttgctggcttcactaacaagtaatggtctcagaaaaataggtgaaaggaattgtaaagttattacaagatgtcatttattttcaaataagaatgttcaactagttaccttattatctttttttacttttcatgagagtgactgtcttccatatgctgataggatttgcaagacacactgctttactaaaatttttaaaactagactgctttaatttgcagttctttaacttgagaactgcatgcttttaaccaataatatttacatgcctgtgtcatctttcttgttcacatttatatcaatgctgagcacagcaaagagacaagtattttagcctagctcattttataccaaccagagccttcagagtacccagaactcttttgccacttaaacagtatttaaatcatctaaatcctttctcattcctcccacacccctctaatgtagagaaattgtctctatgaacagagacaacatttcaactatttcagctatttcaacagatttccaaactccaatgtgtatgtatagcttgttccctcttgtggtggaatacttacaaaaggtaatttggttcaaaatataattagccttggaattaggtgttagaagtgccgcataattttttgacgcagttcagtattttctcctttagcaattctttcatgttattccccatttaaagtatatatcacttttagaaagcagtaggaaaatacacaaccacaatggagcttattcttggaaatgatttttttaactttaagtttaggggtacaagtgtgggattgttacataggtaaacctgtgtcatggggttagttgtacagattattttatcctcaggtgtttagactagtacccgttagttgtttttcttgatcctctccctcctcccaccttccaccctccaaaaggctccagtgtatgttgttcccctctgtgtatccatgtgttctcatcatttagctcccacttgtaagtgagaacatgcagtatttggttttctgtttctgtgttagtttgctgagcataatggcctccagctccatccaggtccctgcaaacaacatgatcttgttcttttttatgaccacatagtattccatggtttatatgtgacacattttctttatctagtctatcattgatggacatttatgttgattccatgtctttgctattgtgaatagtgctgcaatgaacatacacatgcatatgtctttataatagaatgacttctattcctgtgggtatatacccagtaataggattgctgggtcaaatagtatttctgtctttaggtctttgaggaattgccacactgtcttccacaatggctgaaccaatttatactccaccaacagtgtataagagttccttttttctttttttccacaacctcaccaacatctgtctttctttttttttttttttactttttggtaatagccattctgacaggtgtgagatgatgtctcattgtggttttgatttgcatttccctaatgattagcgatgttgagcttttttccatatgattgttggcagcatgtatgtcttcttttgaaaagtgtctgttcatgtcctttgcccactttttttatggggttattttggaaatgagattttaactggttttgttctctgtcaatgaaactgaaaagattttaaattaatcaatacaaagtttatatttgatttgtattatttataagtcattaaaggtaatccttaaataatcctcacattgaaatgtttacaaaccaatttcttcagcctcttttatccagaaatgaaatttttaaaatatgcctataaagatcagatcgttcattcttattttactggatccagatatgttaccattatcctttaaaaattactgactttccatttaattcagttttacttcctctttaaatgtgtgattctctaccttaaataaccccaggatgttttcctagaaattcagtcagccatctgaaagtaatttttctgtctggtatgtggggtttttgatgggtgtatgtggcaagcatatagcttaactatactcactatactcattttcatcaaaatattggctaaaatattcagaacagatgtatatatgtgtatactttttctgagactctagagaaagcttttttgtgaacattaaagggcatgtcagacttatggagaaatttctttgaaaatttttttaaatctttgacaactgtaagagaagattgcttctcaggtgctgtttattaccctgaaacttaatgactttagcgtgcttttagagagtttttaaaagcgatacaaatgaaaaaggcagcaattcagtggtgtttcaacagacaacatgggaatgtatgtagataagaaatcaagagacagaactagttctgacttgattggcaaacagttctgtaaagctcagtttgtcagaaaaatgaagagtattggtgagggtaacatacttgccttagaaggaaggaagagggaggaaaagaaggaaatggaaaattagaaggaaggaaagggaaagaaactacgaaaatagaaactaatgatacagcttggatcctttttggtctagtgtctgaggaaagtcccctatttactttcttaacaagcagtgagttaaatattgagcagttactgtgtttaaggtactgcgctaagtgtgggagataccacagtagacagtagaaaagtctgtcttctcccatgaagtttacagtctagaagggtgacagaattcaagtaactaaattaataaatacttacgtgactataattgtcatgctacaaagaagaactttgagaggaaatgagacaaacacagagaatcctgacctagaatgagaggccaaggattgtatccctaaggaaatgacatttttgcttagctctgaaggatgcatgtgaatttatgataagaagagaggaaaatcagaagacagagtcttagggtgccgggtaaggaaagtgtttcaaggaaggagtagtactcggtgctaatgctacagatacatcagaaaagtcaaggactctgagaattgtgtattggatttagcaacatggaggccctaaaaaccttgacaatagcagttttggtggaatagtggggacaagagcttaatcggggaagattcaagaggggaggagaagaattgggggctacaaatataaagaagctttctacaaggttttctgtaaagagaaacaaaaaataaggtggtagctgggtagaggtttgtggggtgaggagagttactttttaaaaaacgattggagaaattacagcatgtttatatgctaatgggaatgactgagtagaaagagaaaagttgatgatgcaggagaaagaagggaggattgctcaaggcatgcccttgagtaggtcggagggaataggatccaatgagcaacccagtaatttcagatctccctaatgtcacaatacagtataataagtattgtatatatgctaaaggcactaggaaaaagcttagggagcccagtagagtgagcagttaactctgccaaaggggattgtagcatttgtgatatcacctaaaatgcttatctgaggtaaaaattagtttattttcaagcaatgttgtacactagcattaaagcatagcaattttgtattaaaatacagtaattaggatatatcattatacagcacttcatcattgtctatattcttaaaattgtattttgtgttacatttgcttaattgcgctgaatatagtccataattcttaaaaacctacttgccatcaatatcataataaaattcagacaaaatccaaaaaatagttatctttttttctgtgtgcctctataaaaatatttatcttttacctttaccacatttattagaatacaggaataaatacagcacaaaatttctgcctctatggagacaccaattaaaaaactctagatgtgcaacagatattaaaagccaaataaaataatggttatactatgaggcactagcacagtggtatcacaaggcttatgatagggtgccaaatgaactctgcaattaatgcatgctttatacttaaaggaataaaaaattaagaagtggtcagcaaaaatatttaaatgggccctaatcctcgttttctagattatattctttgctgttattattcttatcatgaattagtaatcttaactttacaacttcaaaaaccaatataagtactactatgtaaagatatgtcttaaacttttccagattacttttcagagatttatgttttatttatgttcatttacacaggaatgggtcagatgtatttaattttattaaaccaatccatttgtattaaagccttaaaaagtcatatgagtataaaaatactttgcatgtattaataatagcatatatttgatttaagtctataatgcttatagtactcttgcctttggtgttttgtttcacttggttttttaccaacagcactaaaacattgaatcatagatttatctttccatttgaactttgctgtcctgtgaaattaaaatgctgctgtatacatgcagtagcaaacatattttcaagctgtaatcaatgatctgtatatttggaattagaaataatttaagccatggtctatttttcagtctgccatggactgctatttatacaagaatgttaccttatgttattggtttaactgctttattaagtcgacttcagtatttcagcacaattaaaaatcaatacttataagcaacattatttgttctacctaaatcaataatatactttattttttaaaatacttatttttatttgcattgctgaatctatggttttataactaataaaagcaaaaccttgatgttctccaaaagtaaatttcagtaaagctttttctttcggtttttttctaatttagtatattttccttcaattgtgtattagtaatatacagtataattctgttaaaaaaaaaaagtcacccccggaaaagtcagtgttaaaaatcttctgcataattgtttctatggctaattatacaaccagacatatcaagggcttaattacatgcttcaatgacttagctccattaaaatttcagagatgacgcaaaatataatgaatacaattatgtatttcatattctgtgtgtgaagtatgtttcttcttgtttttgtgcacatatgtttgtctccaaacaaccaattttcaaaaaatatctaactagctttttaatatatataacatatagagcaagtgaaacaactgcttatttattggattttcacttttcaaaagattttttgatgacatgtaaaaacagtgctagagctgttaattgcttcagtttcagtgcccatgctgaagtagagtttatttctaaaaccagatcctaaagaaataaattgtagatattttgaaaatacagccttcataacattgaaaatctggaggactgactgtgcaaagtggtgggaatagacataacaaaaggagaccttccctcaaacctttaccctactttcgatgggcagaatattgacctggatctatagatggctgttgtgagacctcggttcttcttagcttaaaagaatttaaacaagagacacacagcaaaggagatatagtatagagcaatttattgcaaaggacaaagaatattatgaaagttaggttcagaacagacagtacaccctgagagaggattcagggtgagctgctcctaaggatgagaccaccaagactggcactagggagactccctttatgagagtcttacataattattcataaaggagtgggaagaggtgttgctattaagcatattcttggttgtcctctgggtgcacatgcatagtagctgtacatacttgttcatacattgcatgtctcattagcatcttaaatctctatccaggggtgtgttgcttactgttataatgaacaaagggtcggtctgaggacaggtgtaatcaaaatgcatgtgctccctgcaggggaaattccttactgtagatagctgtgtttgaatgagctggactacagtgtgagtgctggggcttattgtgttaactgtattgtcgccatgtgaggacatgtttacttccttgactacctatcctgcctcagatcatctcactcaaattccctctgtgtaaaagagcagagatatactgttggagaatttggaatattaggtgatcatttacaaagttgtttgcataccttgaaaggaagccattaaataaatattacatttttggctcattaataattttatcatgtctagttaatcttcagattttaaaagagcttagcaaaacagactaaactgtatcagtgttcacaataaaaagccataagattgatactttttccttaagaacagaattagaattctcctgacagaattttttaaagcacattgagtgattttaataatcataaaatttagctgggcaaggagggaagctgcagggacagaaggtgactgacagatactgaaaagtggtatgacaggtattaatagattaaaggaggaagaattgttggagtactgtaggtagtgtgctagaaatacaaaaggtggtagttcgtaagctggatatttaaagggattgcagtctttgctgatgagactaagcatatgacgacaggaatgagtgtgagagagaacctcaagaaactgaaaggccagactctcagagggtgaatattgaagtcaccaagaattatgacagaagtgtgagtgcctgggtttgaatcctgatactatgtacttaccaggtatatgtccttgggcaagttatataaccttagtttcctcatcagttaaaatgaggataatgatagtatagttctctgaattatcaggagtaaacaatttaatacttatgaaactcttagtatgtggtatatggcaaatgacatataaatgtttataatattatcagaatcataataaccattattatttgtatgatccagtcctgtgtgagtctccgcttttcattcactagaaatttattaagcgactatttcatgccaggcattttgctaggtatcctgttaaaacttctgaattattttatttggctgttttaggcttcaggaatttcaagtggaacagaaataatatactgcagcctcaccaaaataaaagttattcttgaagtctttgccatgagttctccttgctgaattaaaatgctgtttagtaaggatacagacccagggggaaatggagcaaaccaaagcagtgattacttggatctctatactggacaggctcactgtagcaaaagagatgcttagaagcagactcagctgtaggacatgaaagagaatctaaccatatttttgaggcatggtggtgtccaaaatgtatggtgataggagatgggaagcagcgaagataaaaagttatccttgtggtgttccaacttgaaacagtgggttaatgtctggtagtcaggttaaacacagagagctaccattttggaggttggctgtcaagatatagacacttggatgttaggaaataagatagagatccagttactgagtaaaatcacttatatgattatcttctttaaaaaaaaaaaaaaaaaactatacccttaaagtctggggttcctaagagagctaacctaggctattcattattatttataaaaagtaccttaagtttgctttatcacctggccaataggcaatttcaccttctggctcaaaacacattttctccatctacacaaatgccaaccataatgttgcataagagtgagtgtgtttggtagactttagctaaaaatcagtgtaagtttgagcagacatggggaagaaaaacaatgtgatgtgaactttgttctctgtgtttaggcaagctacgacctatatctatgccagtggaatataattgggtgggggactatgaagatccaaataagatgaagagagatagtagaagaggtaagtgttctagaatttcagtgtaggctgggttgtttgaacaataagcaaatttaaatgttctgtaaatagattgttatggcttcagtggaaaacttattctatcattgactttattgtacaacaaaaccaagtaagaccaacatttgactatcttgacccattattaaacagatattgtctctgaatgccttctaaggggttccaggtacataagtatggtgttaaaagtaaatatctgattattatttgaaaggtaatatttggaacacaaggtcaggagtgtgaaactgcataaaataattaagttcagtgaataggaagagtttatcatcagtcctcatcggtctgcaatgcaacctcaccagttttgtatggaatcaacctcaaaatgagcattgaagcacatgggttaaaagctaatggaaactgggccagtgacttctaacaaaaaccatgtagaaatagaaaaaaaaaaaaccgtgcttttttttcctgttctgtttgctgctcagagttatcttcttacatgggggtgggctactcttgaaggatctaccaaaagtaagtttttatgttcacttatcctgctatagagatgagcaatagagagcaactgaaagtttccctactaaataggatttgatcaagtgtgggtatggtgggcccagtgggtcatgctgctactttgactttctgaagtagagagccgtaaggtcgtaggtggaaaataaaacaaatcaaaacaaaaaactattcatagaatgtaagttcactaagcttccttcatgatatgtttgacccgttttcttgttatttctagccagtatacagaatttattttattactgcacagatccgcagaccatatggacaagcaagcatgaatatctgattcattagtcttcttaatacttgttttatggagtgagcatttctgaaaatgttgataaatacaggaacattgacagattcctttatatctgtgtattcattccattttccaatcttcaatttctaatctcatttgttctatagaataaatcaagaaaagtataaaagagaaatgcttatcacatgctatctcagagtcactgttttgggacttcatattttagagacttttgttgatggggaggggaaccatgtgaagtactaagagctgactaccaatttaagcatagaattcctgaactaaatttcctgactattggttcttaatgtgggccttaacttctccaagcatgctaccttgcatgccacgggccggtgtttgttattgggctttggcaaaatccccatgagggtgattgttacaaattttataagccacacacctagaatttctgattcaagttccagaggtgattctaatgtagttggtccaaagctaaaacttggagaaataatctatcgactgtctattttttattgtcttatcataccaaataattaagatatactgtatttcactacatattttataagttaaatcaagttaaagttctgaaatgaaatatattagattggggcaaaagtaattgcggttcttgcaattaaaagtaatgggaaaaactgcaattacttttgcgccaacctaatagcacaattgagaaagaatggtaaatttggggtatttgtgtatttatattggtgtatttatctctttttatatagaaaactctctacttcggtatatgagcaatgaaaagattgctcaagaagaatacatgtttcagagaaacagcaaaaaggacacagggaagaagtcaaaaaagaagggtgataagagtaatagcccaactcactattcattgctacctagtttacaaatggatgcactgagacaagacatcatgggcactcctgtgccagagaccacactataccatgtaagtaaaatttcaaagactcttcaatacagcttttattggaagactggcaagtgactcttttgggtaaagtctaggttatttttatccttttactagattttcacaaaagagcctaactttaaagtttatgcccttaaaaaatgatgggtaattgatttttttcttaagtttatgtgttcaatgagttcatagttgtagcaagttggattttaatgggataacttaatatgcacaaaattgatggagaacaataataaatagctgattaatcatcagtgtgatactatgcaatgcacagatagctataaaattcaacattaaagatataattttaatatagtcatgattccatttaaaaatgaccatctattattttctagacatggagagtagggctagaggtaaaatgggaagacgtgagacaccattttatggggagaaagacatgctgagagtcccagtataacttaactgttgtgatgggtgggtgcagaaagtataagaggaacataggagaaatagagccttagtctttaggggaagtgagaaaaggcttcagagtggggagcatttgaatggagaataaaatatgagaagcagtattttagtgcgaaggcatatgcaggtgcgccacaaatgtgtgagaatgtggcatgttccaaggattttgtgtggcttatgattgctggtttattaacaattggaggaaatggcatgaggaaaggacagtagatgggcctggagtcataggtaaaggttagatgaggaactgtatgataaagtacttagtttctttcctgcagtaataaagagctattgaataattttgaactgggaacttgcgtgatcaaatcggcctattggatctctctagtgcagagcgtcatttgagagatcagaagcagggctattaagtccaggccatatggatgatgagaaactaggataatggccgtgtggaagctgagaatcatgttagcaagaacatttaatccacaaaattatgcatgttaaaccattttggttaaaaggagtttgttgtgtcactggaactatagcttcttattaggagcccttgaaaaacatggactgcaagtttttaagtaatttgaatgattgtgcttaatgcttaaaatatcaaaaaaattttaatctgcccctgctgtagaaggtatagcatctaggcattcaaaatgtgaaagatttaataacttacaattgagttgtttctctgagcaaatctcttaaatcatctacttattctatagctcttccataaaactagagtgtagaaaaatgtttttttttttggactatagtgttattagcactcctaggtgcctcattctttaccctcccttctccccagttacatactctcagaagtctctaagacactagtgcctgtatcagaatctgctccgttaaatgactgatcgattgaattattattttttccacagacattcagagtcagcctgaaatcagtactcttagtcgtttgaaaggggaccacttttgttattaccactattcagaagagctgtatgagcactgagcttcctctagaatctggtgttccagtcataagtaataccctgaacaaaagtttgaagatgagggacagatggcctattcgagagggtagttggtagtgagagatgaacctagagaaggaagaagagaccatcactttgactcagagtgtacaaattattaaaagtttggatttatcctgagagtagtgagtcattgaaggcacatttaaatactcagcctgctccattctgtcatgcatatcctgacagatgttatactgtgtgcggaaggaaagtagttaagtcttgtgaattatgaagtattaaattagggaagacagtaaaaggtgagccaaattggtaatcaggaatattgcgaatatttttgaggagtataaattgttaccacctttctgaaggacattgtttagttatgtatatcaagaatctgatctactaacttcacttctagaaatttattctaagaaagaaatcagagtccacttttgcctcctgtttttattatatgtcttgaatctgtaacatggtatttcccagatagttgacatctatctcaactaatttttgacagaggaccagcacagagtaaggaatattgttaactttgggggagatcttcccctataatgctgatacaccaattccagagtagaaggctgggtatttcctaactctgttctcaggtttagaagaagcaaaataatcgctaacccccaagtgcgtattggatatctataaccaatgttgtaaaagagagaactctaattggtggggtttttactaggctcttgagttcccttgaggatctcaccttgcccttatttagtgctttcacagttagcaaggaagtttccacatttgatatgtcttttgaacttcacagcaaccctatttgcaaataacaaaactcaaactcagaaatgatttacaaaagctgttttgcaaaaaaaaatacaagtactgttgtcaggactagaaccaaatcacctactccaggggtctttccgcactctatcctgttgctttgtgcatggtacacattccatatacagaggaatttgtgctttaatgaataaatgagtgcatttgaaaggcttgacttgaaaaaacatgtggccttgtatgatgatgttaataatgttttcagtgcctggattgatttcttttttgcttcatgttactatttgttaagttaggggaaacatactgagctgccgctgttataaaacacaaatagttatttagcttgatctattgctgggacaacagaatattatagttaacaatgcttggaccttggagacaaaacaacatacgcttaaataatagctttttatatttcacaggaatttctgttttatttttacctgtttatacatgcttatttaaaaatgaaaggcttttttcttatgttaaattttcctgaaaacacaatgtcagtatcaatctgtaatctaatcgctttcatgatgaaccactaatcttcatttttgccaattactcctttggataacatggccatgtttaatggaataggacttaagtggaagaggactatgaagattgagtattgcatttcataggcttctatctctgccgtaatactagctctatgtaatctaaagattttaagttaaaagttagagaaaatttagtatgaatttaatagcaagataatatcatcattaaatccccttaaacggcaaagtaaaggggtgtgtgcatgcatgcatatagtgttccttataagcacacctagagtatagtcttcactgttctgttgtggaaaacgtcccaataaaaatacacaaagcaagacaaatattgtttggcttcagggttcaactcattatcctataatgaagacttagaagtgtatgggattataaaatacatttttattaattccatatatctgatattctagttcatatatatttttcttaaacttatttaaaaggaaattattcactgtgctgtagctaccctagtcattgaccagctctttgccaccactttccttttcaacatgctattcccgctgctgagaatgcttttatctcttttttctcccaagaattcctgcctatctaaacctgaaatcacaaggacatcttccctgaccactaccctctgaactaaatcagttctcctattttctcttatcatccagtagtttttcttcaaaacctttgttgggatttttaattatatatttatgtgaacatctgcctagtgtctttctctcctgtacatggtaggacaggtatgcctatgttcatgatgataagcagggacaatttctccattttgttcagtactgtatttcagcacctagtacaaatgtagtaccttataagctctcaataaaaatgtcatgagtaagtgaattaatgagtgagtgagtaaatttgacaggaacttcagtggctttctcagtgtcttcaacctgcaaacatagccccctccatctcctaggtcaaccccacaggggcgaacaatgcaagaggattagctgccttacatcccctaccctacctccttcactccagctgaaaacttcagttccagctagttcttgcttgcttcctttccctgccatctcattacaaaggttccaatatgcccatcagccaagcatgttatgacatttttcaaaagagcataactttattttacctacttactgattctgtctgaaaatgtggaagctgttagctgccaaagccctcatctaacctgagagtacatgaagacaaggcagacagaagtttttgtgtggtgtgtgtgtgtgtgtgtgtgtgtgtgtgtgtgtgtgtgtgtgtgtaaaattcagatgtggtaagaaaagtctttaaagaataactgaattattctgaatctcatctttaaatcttgtaggacttatttttccccaatatgatgtgcatatgacaacttgctctcacattaaagctgctgaactaaattcatatacaaaataattacttaggccgagcacggtggctcatgcctgtaatcccagcactttgggaggccaaggcgggtggattgcctcagctcaggagtttgagaccaacctggacaacatgtcaaaaccccatctctacaaaaaatacaaaaattagctggatgtggtagcatgcacctatagtcccagctacttgcggggctaaggcaggagaatcactggaccctggaaggtctaggctacagtgagccatgtttgcaccactgcaccccagcctgggtgacagagtgagacactgtctccaaaaataatagtgataataataatagtcatttattttaagtctacatgctgagatgccagaacaagtaaaattggattatagattcaagcagtatgtaggtatactttcataaactgaatactgatgtaattttggatgattaaaaacagacttttagtaggtgttcaaaaatctggataattcctttcatgacattcaaacatttaggtggcctgtctttgtttttttaggatataactgcaaacattcaattgttttatgtctcataagtactttcagccactctggccaatttgtgaggttttgtggctttttttgatggagggaagaggggtagaactgttaaaaaacatttttatttttttttaatttagcaagtaaataaacattatgaaaatgctattctgattactttacaaatactatcttatttaaatctcataatgctgtgaggaagctcagttgctggtgttatcctcattttacagactagaaagctgaggcacatggattaattaggtagttatgtggtagagctaggatttgaacatttgcactctggctcttagcatactatattgcccctcaaaaaatagcataatttaacagaaacctaacaacagttgtatagtggcaaccacgtgtaaagcccagtctaagtgcagtggtatatacaaagactaatacaggcatatctcagagataatgcatgttcagttccagacaaccacaataaagtgaatattacaataaagcaagtcacacaagattttttaggttccctgtgcatataatagttatgtttatactatactgtagtctgctaagtgcacaatagcattatgtctaaaaaacaatgtacataacttaattaggaaatattgctaaaatatgctaatgattatgtgagccttcagcaagttattattattattattattatttttgctggtggagggttttacctcaatgttgatgtctgctgactaatcagggtggtggtagctgaaagttggggtggttatgacaatatcttaaaacaaaatgacaaagtttgctctatcaatttactcttcctttcacaaaatatttattagcagcatgagatgctgttcaacagcattatatccacagtagaacttcattcaaaattggggtcaggctctacttccaattctagttctcttgttatttccacaacatttgcagtgacttcctccactaaagtttagaacccctcaaagtcatccaggagggttggattcaatttcttctaaattcttgttaatcttgatattttgacctcctcctgtgaatcacaaatgttcttaatggcatctagaatagtgaattctttcgacaaggttttcaatttactttgcccagatccatcagaggaatcactatctatggcagctatagccttacaaaatgtatttcttaaataataagacttgaaatttgaaattactccttgatccatgggcagctgaatggctgatatattagcaaacatgaaaacaacattaaccttgtacatctccaacagagctcttggttgaccaggtacattgtcaatgagcagtaattttgaaaggaatcttttctttctgagcagtaggtcccaatgatgggcttaaaatattcagaaaaccatgctataaatagatgtgctgttttccaggctttgttgtttcatttataaagtacaggcagagttaatttagcatcgttctcaagggccctaggattttcagaatggtaaatgagcattggcttcaagttaaagtcatcagctccatcagcccctaacaagagagtcagcctgttttatggtttgaagctaggcattgacttctctcaagctatgaaagtcctagatggcatcttcttccactgcaaggcatttcatctgtattgaaaattctattgtttagtgtagccaccttcatcaatgatcttagctagatcttccggataacttgctgcagcttctccatcagcacttgttacttcaccttgcactttttttgttatggagatgccttctttccttaaacctcataaaccagcctctgctagcttccagcttttcttctgtagcttccttacctctctgatccttcatagaattgaagagagttagggccttgctctggattaggctttggtttaagggaatgttatggctggtttgatcttctatccagaccactcaaactttctccctatcagcaataaggctgtttcgttttcctatcatttttatattggaggccttgctttcagtatatcttggcttttgacatgccttcctcactaagcttaatcatttctagctttgatttaaagtgagagacgtgtgactcttcctttcacttgaacacttagaggccatcgtagggttaattaattggcctaattttaatactgttgtttctcagggaatagagaagcctgaggagaggaaaagagatcggagaacagcccattgggagaacagtaaaaacagacacaacatttattaagtctgttgtcttacatggcttctttctttaatcctcataaaccaacctctgctagcttccaactttgcttctgcagcttccttacctctctcagccttcatagaattgaagagagttagggccttgccctggattaggctttggtgtaagggaatgttgtggctggttttgatcttctatccagaccacttaaactttcttctgttttcttctgtgtcagcctgtcttttgaagctttgaagccaggcattgacttctcctctctagctatgaaagtcctagatggcatcatcttccactataaggctgtttcatctatattgcaaatgtgttatttagtgtactgttgttcatggcaccccaaaataattacagtagtaacatcaatgatcactgatcacagatcaccataacagatataataataaagaaaaagttttaaatattgtgagaattaccaaaatatgatacagagacacgaaatgagcacatgctatcggaaaaatggtaccaatagactcattcagcacaagattgccagaaccttccatttgtaaaaattgcaatcttcaaagaataaattgaagcacagtaacaggaggtatccctataatatttccactgctaatattactaatagctagcatttactgattacttactaagctccaatgctaagcacttaaatacagtatctcttggaatcttcaaaatgatcctatgaggttgatatcattatttctattctgcagaactgaaaggaactggaacacagaatttaccttaaagagctagaaaatagcagagtttagaaatgagtccaagcatcctgactccaaaattcacacctttgtgtgactaaagccatatctgctcataaggattttatcatctattagggaagacagagctattattatcacaataatggaaaaactgtgatattactaacatataaacattcataattaaatttacctgcagttataaaggttggtttgtctaacggctgcctgacttagctgcattctttcaggataaaagtaattcaaagaagagatcagttattttagtggcaaagaagccacctctaagccgtcacttgtttataacaaccaatttctctccgttttgactttattcacccagaagacagctgtattacagaatgacatgatgtttctcccaatcaaggtacatttagacatgttagagtacaacagtacactaaatattatcatattcatttgtatattctctgattcctatggatgactttattatttctaaaatgtttcatagtagcatttgcaaacccctacatgggaacagtctgtactatgaaaagtatttcccagtgggctgcttccctacagcagtgattcccaaagtatgggccatccttggcaaagggctctgatgactgaggtctgacccagaagtgacagtactttctttgattcttatgggcaaataacacatcacaaacttccattttcacttgtgactagatattgcttactagtaacctactaaatgagtttaaaaggttacaaattgaataatcataaaataatacattcatagaatttattgaatattctaatttagtattttttcagtatgcctgtgttttagttcattcttatactgctataaggacatactcaagactgggtaatttataaaggaaagaggtttaattgactcacagttccacaggactggggaggcctcaggaaacttacaatcacggcagaagaggaagcaaacacatccttcttcacatggcgacagcaaggaaaaccgcagagcaaagcgggagaggggaagccccttataaagccatcagctctcatgataaatcacaatcatgagaacagcatggaggtaactgctgccatgattcaattacctcccaccgggtccctcccataatacatggggattgtgggaactataattcaagatgagatttgggtgggaacacagccaaaccatatcattacgcccttagcccctcccaaatttcatgtcctcacatttcaaaagagaacttcccaacagtcccccaaagtcttaactcattccagcattaactcaaaagtccaagtccaaagtcttacctgagacaaggcaagtcccttctgcctaagaccctgtagaatcaaaagcaagttagttactgcctagataaaatgggggcacaggcattaggtaaatacaaccattccaaatgggagaaattggccaaaacaaaggggcaacaggccacatgcaagtctgaaatccagcagggcagtcaaatcttaaagctccagaatgatctcctttgactccatgtctcacatttaggtcacactgttgcaagcggtggggtcccacagccttgggcaactctgcccctgtggctttgcagggtacagcccccctcctaactgctttcatgaactggcattgagtgcctgcagcttttccaggagcacagtgcaagctgttggtagatctaccattctggggtctgtaggatggtggccctcttctcatagctctactaggcagtgccccagtggagactttgtgtggggactctgaacccacatttcccttctgcactgccctagcagaggttctcaatgagggctccacccctgcagcaaacttctgcctagacacccaggcatttccatacatcctctgaaatatgggcagaggttcccaagcctcaattcttgacttctgtgcacatgcaggctcaacaccacatgggagctaccaaggcttggggcttgcaccctctgaagccatggcccaacctataccttggccccttttagccatgactggagtggctgggatgcagggcaccaagtccctaggctgcacacagcagagggatcctggacctggcccacaaaaccattttttcctcctaagcctcccagcttgtgacatgaggggctgccattaaggtctctgacatcacctggagacattttccccattgttttggtgattaacattcggctccttgttactcatgcaaatttctgcagcaggcttgaatttctccccagaaaatgggtttttcttttctactgcattgtcaggctgtaacttttccaaatttttatggtctgcttcctcttgaacactttgctctgagaaatttttttcaccagataccctaaatcatctctctcaagttcaaagctccacagatctctagggcaggggaaaaatgccaccagtctctttgctaaagcacagcaagagtcacctttgctccagttccccacaagtttctcatcttcatcggagaccacctcagcctggacttcattgtacatatcactatcagcattttggtcaaagccattcaacaagtgtctaagaagttccaaactttcccacattttcctgtcttcttccgagtcttctaaactgttccaacctctgcctgttacccagttccaaagtcagttctgcatttttgggtatccttatagcagcaccccactctactggtaccaatttactgtattagttcattctcacactgctaataaagacatacccaggactcggtaattataaaggaaagagatttaattgactcacagttccacagggctagggaggcctcaggaaacttacaagcatggcagaaggggaagcaaatatgtctttcttcacatggtgacagccaagagtgaaggggaggggaaagccccttagaaaaccatcaaatcttatgagaactcactatcacaagaacatcatggaggtaactgcccccatgcttcaattacctcccactgggtccctcccaccgtatgtgggaattatgggaactacaactcaagatgagatttgggtgggggcacagccaaaccatatcagcctggtacctatgcagccctgacagtgcaatcatgttcatatcgcacaagcacaagtgtagatgatccagttttctgtggttttcaggaggaatgctctattgatacatcattgggattttttaaaaagtaacctatagttttcagtggctgtttattttcattataagttatcattagacttcatcactatcaattttagtttgttttaggttgcttgctttaccctctaatatgtagtgattcatatttacctataatttttcaagaatgatactgtgaatcatccatacccaacagtacttacagagtaatcgtctattggtatacctagttattttttccattgaaaagtagagataaagagatagacccaagggatctgttggcctgtcttagggaaccacagtcaaaaactgtggaaacccactacctagatacagatatatggttaaaagaagaagaaaacaatattggctttacttggttataaatataaaacagttttggtgaatgctagtccacaaaaaattagttcacttgtacttcctcacttatttatataatttgttctttttgctttcatatttaggaaggtttggtttttttattaaaaaaaaaatcaactatcggtactcctcctatccccccatattctcattcaccgcaaactggtgtacttataatggaactggccagactagaggatttaataatagaattactctttgaagatttaaagattcacaaatacaaactttcagtcccagataagatggagtacacacattttattttatttttcctgctactcacaaccaaaaattacctggagaaaatacattaactcatctaccagaagactctgaaaggtgcaaaaaaataaggcagacaggctagagacctccagacccaaggaagtgctgtgagttcccaggcttttttacttgcctcctgtattacctggcctgggtgttataaaagcctgcaacctgaaaacatcaataggcaccgacaaaatacagtctttagccaacggactctctttagccaacatgacagaaatattttaacaacacctgcctcttctcaaggcagaaaccgtgaaaaaagtcatgcttctcttccttcaccacaacaggcataaagaggttcaattcactaagaagacatgacaatcttaaacatgtatgcaccaaataacagagattcaaacagtagaagcaaaatctcccagaactggaaggacagattgaaagatttacaattaaggttggggtcttcaacatccatctctcaataattcatagacccactaaacaaaacaccagcaagggtacagaagtactgaatgactgtccaccagcagtttctaactgacacccaacaacagcagaatacacattattttcaaatgtgcatgagatactcatcagaatagaagttatcttcagtcataaaacaaaccttagctttaaaagaacttgaaataatacaaaatatgttctctgattataatgaaatcaaactagacatcagtaacaaaaagataacaagtaaatctccagccacttggaaattaaagaacatacttctaaataatccataggttaaaaggaagtataaaggaaaatgaagctgagtgaaaataaaaagcatatgcttagaggaaatttatagccctaaatgcttacatgagaaaagaagaaagatggcaataatctcagcccctacctcaagaaattagaaaaagaacaaaacaaaaagcagaaggaagatttaataaagataatggaattcaatgaagttgaaaacagaaacaataggtaaaatcaaaccaaaagctatgggattttttaatttaaaaaattgacgaacatctagcaagactgataaagagaaaaaggagagaagactcaaatgaccaatatcaagaataaaataggcgatatcactacaaccctcatagacattaaaagaatactaaagaaatacaactctgtgcctgtaagtttatcagttcagatgaaatggaccaattcctcaaaacatacaaactgccaaaactcacccaaaatgaaatatatctgaatagttacataactattaaagaaatttaattaactattaaaatttccaaaatatcaatacagaaatactttaaaacaaaagaagcaaaaccacagtactaatatttttgtattgattgagtgtgggaataaggaattttgctttcattgttatgttctgcgctgcttttaaagtgttggaagcctataagagatttgatgtacaagacttgtaacttaatggaattcctaagatactgattaaattcatcagttttattaattttgaaaatattgtttaaatgtttagaaatttttatttcctcaatttttaagttttaaaatttgaaaactaaacaaacaaaaagattcacaaatatgccctcactcttgagaaagatttttgctccctgtataaaacagattactgataaactgaagccagccctttcagcttcacatttgaacaaatgtgggtctcagtctgctacttcctgggtagaaaatgactgccaggaagcaaaacacaaaatttggctcaattagtgatgcaccatgtaaaacatgatgcagaagaattgaattataaatttattaaatttaagtcttatttttaattcctttttgcctttagggaaaaaaaatacacaaattctaataacaggcccttggcttggttggtaagttcagtaattaaaaactatttggggacatacctgcctttagttgctttgatcagagagcgtaaagaagccccattcccttttatgttgtagacgtttgtctcctagctttatagcctcagaaaatgtcctcaaattttgtaggcaattggctttttttttgctcccataatcaccctactcgtattaccttgccaccataactcatttaatcagacatctcaagtttaataaaactgtaggtagaattatcttacccctagaattctttaaagcctattctgattgaaggtcataacctgtaccaaattattttcttcacttaactcccacaatatattaatattactcccttgatggtttcagcactctcagcctccacaaaactatgggtataatgatttgctgtatgtactaaaattatccaaagtttcctcttaataaatgatattaaggtacaataatttattactgttagattctagttttttaaagataaattttctaagaactatgttaaattgtttgcagccattatggatttttcactagttttgactctgacagcaattggcaatggaccaaagtgcataagctcaacctagagtctcagttctaaatgatactgctaaatctgtctcttaacatttctacaaataccagggtaatttaggaacaggatcctaatagacttcaatccaaaacaacttggaatgctgagaaatagatcaatgtttcaaacccatgttctttatatgtgactgattttaggtaaattagtgtaaactttcctgccatagtaaacaggagaataagttgtcttcccatggtttcttttattttcataaatctagagtggtcccaagacataatggttcttgtgtctgatagtctccagataagagttcagcattaagaagagaattgccttttttaaaattcagctataggtcagctatatatttaaatatatatagctatataggtcagctatatacttaaatcagctataaaaagctaggcacatttctgaacctcagtttctcataggtaaaaagaggataagactacttacctgttttttttttttttttcagaattaaatcacacgttgtatataaaattatttccactgtgctgagcacatactagctattcttaactccatatagaaagaaaattagttactctgcatgtaagggaatttatcttctgatgagcaaatcaggaagccttctaggactaaaacagaatgcacttcttttgggcattaatgagtatatccattgaagtacaaccagggaactagaatctctaagtggcatggaataaaggactagatcttattcagttgaggagctggcaaagatgcctcagcagagccagtggttgggaagaaaatctagacatgaagtgaggaagaacaagacaaactagaacccatgagcacaaaccagagcatttcctccaacttcaacaagaagctggtacccttctccatggagattcacagattcatggtcccatactcaggtgctgaaggaggagatccgattggagctgaaggagttgtagacctggctgctgactcacaccagtaaggcaagccaacagaaaagtaaaacaatgtgtatcagctgcagcagtgactgacaccctgccctgaccttcggagcaaaagagctgctgctttacttgtattctccaaaactgacacaaatttacgtagtggccaaccctaaactagaaccatatagacaaaagaattctaaaacacatagttccttccagcttagctaaattgatgcaataggaaactaccaaactgaggtttccttctctgtggccattatcagtgtttactgtgtaaaacctgctttgaaaattctctactgggagtatgtatgaggttcagtggtaaaataaaaatcataaattatcataaatctagagtggattcaagagtgtagcctacctctatgagagtaccatctccacaacctacttctttaatttaccaaagcatatactgagaaatacatcttagccaaatgttgaatcttcttcacttagttgcattttaaaataatgtcctcaatttttatcatatggttattacaagaaacagccatatgaaatacacttcttcatttgctataaaatgttttttgatattgtattttctatttctttgtaccttccatcatatatatttttataattgggtaaaagctttggctctgtgtggtgacagtatatgtaaagatctgattcagtgtctggcactatgatagtgcacaaatagtatacccttcctccaacagtactaccaaaatgtcctcaccagtgggctgagaacaagcaaaatgtaatctaggtgcatttgaggtaaccagttctgaagaagtggcagcaaatatcaagccctccagaaatttaattttttatactgagattgcgtaagttgcctcctttcttttactcagttttctcatttacaagacaagtgtagcactgcagagaggactatgaaaaatgccatctaaattgacagcataatgatgatttgattcctgctgcaagcgcagaagttaaaatatctccccatcaagttcttttttcccttctgttagataaaaccaattttcctttttttagtcttaaaatcatgttttactatatagttcagtattaaaaggaacagtctgaattatatatctcaattattttataaaataaattgcatatagtgacttttgatactttttaaaattctatttttatacagtactctttgaaaaatatttctgttatgaaaaaagtctctaaatcaagaaaactctattaaaactaccagatgtagaaacatctgaagtagttgtgttggagagcttgtctattatataagagcaaaaatatcagaataagagtttaacagaaacgtagtattaatatgataaagatatttagataaaagctagcattcttggaacaaattatactgacacagactttcataatgagaaatatgtacattatatcagagaaatcaacctaaaaataaagttaaagtaatcagaaaaaaactttgatttcagattcttttacaaataaaaccattaagtccacaaccagaaaagtttttcagtaaatatgattcagtcacatcattgctgacagaatcatcaatcataccataattgtgacttcatttgagattcttgggtttcatgcatctctgttagaggtgattctttctatattatttattcctctatttcttttacacatagtttatttccttgtcattcattagcctgcaggtagcaaatctggtcctctccattttttctggttataaacatttctttgtcacaaaagacaggcaaatctactcttatttctctgacacctaaatttcaacggtttctgtcaaacagaagtgtcaggagtaggagctgccctagttctgcttttcacctgttagaacttgctgcctctgtctcaagtgcaaatctatgttaattgtacacatcaatcaggcaccccaaaatagctgtatctaatatggctggtgataagttatttccatacatggtggaattcaaacataaactaagtgcttttcaatgaataatctagcattcagtgttaagactgacactgattacaggtatacatataatatttcctaaaacatcaataattaggtctccattggtgatcattaactggttttccattcatttttaaattatgatcctggaaagttattgttctatgagacatactaagaacatgtggtccaaatccctgatttcgcagttgaggaaattgaggtcaagagtagtccagtagcttgatcaaagtcatagagctggaatatagactgaaatatgaactgaaagtcaggtctcctgattcctaccatggtgttgcttcattggtaatgtgtgttcctttcttgctgagaaatgagcattctaagtgtatcactccaactgatttgttgaaaatagactgaaggggccaagggtaagtgtggaagcggggagacaagataggatctggtcaattcaagtgagagatgagagtgacttaaccctgggtgttaaagtggaagtggtgaaaaggggttggactctggatatgttttgaaggtaactggacaggatgcgctgacagattgcatatgagaagccatgaatcatagcccatacctcagtgtcccacacataggtggtgagtaactattcaattcatgccttcaacagataattgtatgtcgcatcctgtgctaggagctgagtatagagtggtgacctaaacaaatggtttctgccttcatagaactaatatagtaggtaaaaaccattccttcagaaagtgagccaagtaattccaaagcattgcgtagtattgaggagtgttttgggtggaaaatggcataacacaatgaatcagctcaagagagtaaagaattagtcaaaaggcaggctggatccatgattttctcatcagtattgacacagggttttctaattgaactgagttctgttaataggcttgtactgaaatgtaattgcagtcccatctctgtctacttaggctgggccttataatattatcgtaccttaatttctgtctcaattgcaaaattaagatgttaccatgagccttcctttcatgcagatgttattataagcggttgcccagaaactcctgtaaatcttcttttataacctacagagcaatataacttgctaattaaaataaaattgagaaagcatgaaaattagagattgatgagatgttattggtttgaattatctccattgatataaaagtgtttttctcactgataatctttctgttttggagaatcctttctcttcacatagcaatgtacttgcatcacctgtcatgagatgttttcataaatggatgtcttagtgccagaagcactttttctctctctttaattgttactatgactacataatacttacttgggaggcagtaatgcatgtagtaggagtataggttttggggttgacagacctggctttgaattttgactctacccctacctgtgtgatcctgagcaacttatttatgcattctgggtctcagtttcctctttcttaaaatggggttaatgataaccactttacatatgtattataaggattaaaatggatcaattacatcacttataaacacttgtaagtgcttaatattgtgcctgacacataataagccctcagtaaatgattattattttgagctaaggatggcagttcttatttcccaagggtattgattcatgttagccttcctgaatattttccaagtaatcacttcccttcttcctacattaccactgtgtaggaacaggaggactcaccttatgggatcctgcatgagagtcaatcacatccttccttcagaatctgatacatatgacattctttttgatggaacattaactctgcccaacctaagtagttgtagtttgactgaccttctctagattcttaccaattactgtctttttgttcttatttgactgctaatttactggtttataaagcatgcttatttttgagtaagtgtggagccattttcagttatacatgtaccccgatcctaaaataaaagtttaaaaaaaatcaggtcgacctgactgacagaatccagagctacctcatcccactctaatgaaagacctacggtgtgtgcagtgccacatccttcaccctgattgactccaagtttttctttcatgcaccagaatgagcaaggccaccaacaacagcagacttaagttctatgctgttatttcttataaatggaaattttttgacttaatatttggttctattgtcatcctatcccatttccatatatttacttttttcttcctacatacaataattagaaagttaagagaaaacattttttgtaaagtatttaaaatctcaaagagttttacttgtttatttaaaaaaaaagtgtggaagcagctatcatctaaagtgtttcaaattgttaagcaccttcttttcttatgtataagaaagaagctattggtttgactagtcactgaagaaatcttggaactttgcagaaaattacagtaagaggaaattgctattactgcaacaagagagtactttgattgcaaatttttccttaagtgtgtcaatttgcaacttgagaagaatttaatagtagctgagctttcaaaatgtaacacagaaactgatttttttcacaattaaaataagtgcttctgataatttgaggataagaatgacccaaattaccctgcccccacacttctccatccaaaagagtggggaatgaagtttgaacagaacatctgtggacagaatgaaagacaaatggtcttttcaggcaaatgtctgaaaaagggatctttcatagccaaacagaatactgttgcatgcatcgccatggttaagaagatcaaaaatactttcataatagccttttattttagcacattctatttttatggaaagaattatgatttcaacacattcattcataactcatataattattagcataaatatcttttgacacagatttaatgtacttttgccaggcatattgtgaatttaaatttaaactgttaaatgcactaagacaatctcagtgcaagtagtgctgaaggagattggataaaaggaaattcttcttatctaccaaaaggaatggcctattaaagaacagaattttcaataatgtattatacatggattcatagacttcttcaagttacaacaatcagctaattaagattacaacctgtattctttgctgatggtttgttcaacatccattcacataaccagtatttattgagtgcctactgtgctaagtcttactctaggcagaggacaaagcaatacataaaacaggcagaattgcccttttttaatggagtttatatttggaggaagtccaggtgataaacaagaaatataaatacttaagataatgctaaatgctcagaggggaaacaaagctgggaaaaagaacagaaagtattgagggcaattgggataacaattttggacagggaagcttgggtagaatttactaaaaagaaagcctttgtgtaatgacttgaaggagttaagggagtgagccacaacaacatctgggcaaaaaacatttcagacagaagaaacagcaagggtgaaggtcttgggatgggactgtacttggcataatctaagaacagcaaaggtagctggaacaaaattagcaaggggagagcagtaggcaaaggtaacaggggaccagatcatgtagggccttcaagtcattgaaaggatataggcatttattcagagggacatgagaaaccattgatgagttttgcatataggaatggcatgatttaaatcatattttaaccagatcactctggctcttgtgctaaaaattagagggggctggtcttagtggctcacacctgtaatcccagcactatgggaggataaggcaagcagatcacttgagcccaggagttcgagaccagcctggggcaacatggtaaaaccccatctctactaaaaatacaaaaattagctgggcatggtgctgtgtacctgtagtcccagctactcagaaggccaaggtgggaggatcacttgagcccaggaggcagaggttgcagtgagccaagatcatgccactgcactccagcctgggtgacacaagaccttgtctcaagataaatatatataaatatatatatttatatattatataatatatgtataaattcataatatatatagtataaatatattagagagggtaagagcagaagcagggagaactgtcagggggtatttcagtaatccaggtgagagattgtggtggcttagaccagggtggtaataatagagctggtgagaaaaagtcatattataaatacattcattgtgaaaacaaagctggtaaaacttgctgatggattggctatggggtataagagaaggaaaagagttaaagttgactccaaggttttgtacctgagccactagggaggaaaaaaatgtaattactatttaataagatatagaagagtaggaaagaagcagatttggctgatgagtgatagatatcatgagctcagttttgtacatattaaatccactcagttaggcaggctttagctcagtgaagaagtcctggctagtggtatgaattcttaagttgctaaaggtcagaatttatggaacattcttagaaagttcgaagaactttcacccagatgctcactataataaacagaaagtgctagtgaaggcattagaaagattttaataaatgatgtttttggaaaaaatgaagatgggaatttttagagaattggacttcaaaaatgctaacaagagaaatccatttttggtgatcaataagcgttacaagcttgtgctttaaattcacatacatacacaccctcacactcaccctaccctaaacacatagcaataaaatgaaataaaagatatggtcatggtcaaaaatgaaatctaatctccaggcaccagaaggaacaaaaatgctcagtgataattgggacctaaagccacatatcttaggcaccgagtccagaaaaagatagagatgcctgagagtcttctctaatgagtatcagagaaccaatggacctcagctatgtcggaaatctaaaaattgactcacgaggtgtaaccaactgggaaggcaagcagagcttcctcattcatgagtaaggaggttaaagatgcagttactaagaaataaataaagatacagctacttgtataaaactgaattcctaggtgtctacaagtaacaaaaacagatactcagaaccatgggccatgcctctcccacttggatttcatggatggaactgcaacccattgccaccactaaaacgcctggttagtgtcccaaggaatggaggcagagacagcaagacgcttagttaagagggatgagtgcaaaaagaaacatccctccaggaagaaccttccacccaagctaaaattccaaagcgtctagagaaaattaatacttttttaaaaaaggcaataaactaaacaatgaggtgattttcttcactaaatgcaaattacaagaaggtcacaaaagcccttaaaatacatttttaagtaaaaacaggaaggttaaacagtggatattcaaaagagccactatcaactagatacactggaaatgtaaaatatatgaaataaacactctatcgataagataaactttagattagattagatacaatcagtgaaagaattaggaaattggaagacagtaaaatgaattcccctaaaaggcatcgcagaaatatgaaaggatacagaacatgaaggacacatggaagataaattgagaggtaccaacatatgtctagagttttaaaaaggggctagtaaagaagaccatttgaagagattttcagaattaaataacactttcaatacaacacaaaaattgccaaatagagtgaattagataaattgtaacctagacacataatagtgaaactgcagaatattagggataaagagaaaaatattttagaagctacagagaaactaaagacagattaaaacaagcaaatgacagtgtaactacagatggcttaagagaagaaaaatagatgcaaaaagaaaataaagtaatacattcaaattgctgaggcccaactcagaattctatacccagccaaactattattcaagaggaaaggattttcaaacattaaaactaggagagtttgccactcacagactgctgtgaaagaacttctaaagaatatacttacttgagcataaacttggaagaagggtaatctgaagctaatatgaaatatacatgaatgagatatattatgaatttttacctcatgagaaatacacttaccacgaatgcaaagattctaggcctctttcatttttcagttagttgttgtagcaccttatatgatcagctgtgttatgaattacggtcatatgtctgtttttaatgtcttgctcttattaaatttgcataatcttaaaactggaaaaaatgtaccaattaaatttctgtcactgacaatgaataattccatcagttctgctagaaaagatgatacaggatgataaatttgcacctcaggggtgcttactaacactgtagctgatgacataaggaaaaccctttctggagattatttatgtccattatttatgaataatgaacagtttctaatataagtttgtaagggatctttttgaatgtgaggctcttttggatgtccccaagaccacctacatgttcagtgatttgctagaagaactcataggactcaacatatagttgaactcacagctaggatttattaacagtgaaacagcaggaacctacagacagatcagtaaggaaaaaagacacctgtggaatctagaaaaatctatctgcaggcttcctgtgctctctccctcccatgataggtcacacagagcatactctcctcccagcagctaaaattcaatcacatgtgtgcagtgtttctgtccagggaagcccgttagagattcagtacccaaggatattgaattgggcatgtagacatcctctgcctagcaactaccaaaattccagacttccagaaggcaagtgaataatcagtgccccatgtgggcaaaataatcttatcatttagggaagcttcttatcagtatagggaactgtttaccagccaagttcctagatgccaaccgagggcaaatactgcaagtaggcctttctaagatggcaacctcaggcctgctacagtaactcttttctgcacagagacctaactgtatagttttaatagattttcccattacttccaaaagcatataatacaattaactttttcattttagaaaatgtcaagtcaattggaaaaataataaaatctctcttaagagaactttattttaatatttataatatctttaaaagacatctaaggctttgcttctttgaatgatggataaatctgtatttaatgtcttggagttttcaggtttccagtgcactgattatactctgcagtcatgatctttatggaaatatatttataggaaaagaaaagataatcttgttaaaaagaaaacctggagagtgtaaaatatgtttcatgtagatttttagagtagacattcaggttctacagaatagcatgcaaaaagcatagaaggtacattatataacccagttctttcaagctgtctgtaatctatgtagctttctaaaaacaaaccacctccatctttgtcatttttcaaaataatgagctgtaaaactataatgattacttgcagaaatacaaagggaaaaaaaaccccaatcagtaattttaccatgaaacaatgtagggaaaataactatctgtaaatgagctatacttaagcacactagcctgagttattatttgagttattattttgaagcaaagtgcattcaagaaaatcaacacagcataatgggttttatcttttatgctttctctcaaaatttgtgaatttctataaccatgcatgctgcaaagtttgatatgtgtgtgtgtatgtgtgtacacacacacacatataccacatacatacatatttataatgctttaacacttaggtgattatttctggaaagctttgtatgtcagcaaattatctgacccttatctttaggactgatacacatccgtagtactatgttcattagacttatataaatcatatacagaacaaaaattattatataagtagaatattatttaatgagcaatgatactaaataataaagtatcacaaaacatgaatttattgtgaaaaaagaccagcaaattttatataagcaaaatccagttgccccttatagatatatctttgtaaagaaaaagaagaatctgtaacctgattttcattttgaaggaatatctgtgaattaaaagcacacatgctatctctgttcccttttagctggctgatcatgtgaatgtaatgaatcttattataccagtgaacaatatggcttagtagactaactggagccagtgatgtgtagtcattaattgaaagttagaccaatcaatatagttgtgggtttttctctagacatatcaagctcttcaggtacttagcatggagtgaacagacaggtaggtttaactgggatggatgtttagcttggcaagtatgatgcagcgagcatggtcaagggaacgattataatggtatcccatggaaactaagaggaaagaaagaaatacaggcacaagagggtagttaggtcaatgaactggatgcctcaatgaagtttttttttaagtgatgacatgaaggtattagagactatgtaaaccatatgaattagatacagtggctggtgtgtgctttagatatcaaacatatgattatgggggtaggtagctgaggagtggggaagtaaatgttattagaactgaggaaccagggtgctgacatcatctacatgaagattagtcaccaataatagtgacagaagtaggcatgagaaaaaaatattgttccaagtgctgaaatatgtagggactaaggaagtaggagaacagtaggtgatggtggcttatgtaatagaatgaacttcatgtgaacaaaggatagtcatattttcctgcttacttcattagattttgtgagactcaaatgagatactgtctggcaaaccacaatatacccgtgaaaaggtacaaagtagtgtgtatgtgtaaaagcctttagttttaccaaatgctttgtgccctgatttctctgcctacaaaatacgggtaaatataatatcctttcctgcttcacaggagattagaaagttaagtgacatgatgtatatgaatttgttttgaggctttgtggggaaaaagttcttcccctaacagtgtttagagtcatcatttagctcttgagagttctgtgtagcgtgctggtgctctggatcacaccctgagtatcagataacattctttttatctttgatttcagacatttcagcagtcctcactgcagcacaaatcaaagaagaaaaacaaaggtaagaaaaggaaatgaaacctttacctgcttattttgctctttgataatccccaacacacttcatccatgccctctttcttgcctgagcccagtgtggtttagaagagcacaacccccttgtgcgaaagctgccagcttcttcttcagtgcaattataatacaaggtaccttttacaacaaatgatctcaataagttttgagagtggtgttacatatttctgattaagatgtgtgtcacttatgtgagggaaaatattaaagatttttatatttttctagtctaatacaatataaaaatttttaagattttcaagaactcatacttctttttggtatctatagattaatcctctactttcatacctttgacaaaattgaaagagcatttccaccctttaggtcctatagcaggcaagagcaaaagacgaatttcttgcaaagatcttggccgtggtgactgtgagggctggctttggaaaaagaaagatgcgaagagttacttttcacagaaatggaaaaaatattggtttgtcctaaaggatgcatccctttattggtatattaatgaggaggtaagataaagcaccttttgttttctcatccattctctatctttaatcaaaagaatcattttgagacttatattttaaaatcgtataatcaccttaaggccaattcagtagacttctgctaggtatttttcaatccaccctcttaaaatgattgcatgttggggttctagaaagatagctgtctcaattatgctaatgtagcaacatatctgaaacacagataaagtgtagtaaaattctgtatatctaaataaaaatgcgaagctaatccaagcagtagcttaactaaaaggattatatgtggaaatttgacattaatttttaaatgtcttgcttttgttcaaaattttacacttttttctggttttttttttctttttagaagtggggaaggggaagccctttactaatttaagtaaactaataccacctgaatttatttccatttttctttaaaaatgatctagtagactagttttgaaaatctgcaagtattcatttcacttggcccagtgggggggtatatatataatacatttaaattattcttatgattttctggggtgttttaatataacagatttatatccagaggagtcatatcaaaacttattacgtatcttgacagatatgccaaaaacatttgttgatattccctttattctgcatttgcttttattcctttgctatagccatctactagttcactttattagttttttaaaacaatgatttctgctatttccttattttataaaaaatgtacatggcttaatgtagtgtgctgggtgaatagtccaatactattatgttaagacattcatcaatttgcatttgaatattgttgaaatataatttaacaacattattatgcctacgattacaaaacataatatctagataattttatgttccctagacaggttataatgtagtgttatgttgtgtttaagagtagactcagaaatcataccacctgagttactgtgccatagtttcttcatctgcaaaatgagagtaataataatgcttatcactggactatcatatggatgaaatgaatcaatgcctggcacatactgagtgttcaataaacatgtggtaggctgggcccagtggttcacacctgtaatgacagcactttgggaggttgaggcaggaggatcacttgagctcaggagcttgaaaccagcctgggtaacatagtgagaccctgtctctacaaaaaattaaaaaattagccaagcgtggtggtgcacgtctgtagtcccagctacttgggaggctgaggcaggaggattgcttgagccagggaggttgaggctgcagtgagccatgattgcaccactgcactcagagcaagaccctgtctgaaaaaaatgtgtgctattagtaacatttttcaaagggacctctcattttatttgtaaaatcttgaattaatatttttctatttaatgtaaatgtctatatcacctatataaaaatatttggttgttttctgtacttttgacatttttgtggcaaatcacacaattacctaaaataccctctgcttcgctaagtgtgtcttattttaaatgtaggaaacaagccataattttacctacagtttcatttaatagatatatattaaatactttttatatgccaatcaaatattatcaagatatagtatctccatgtttctctttattgtaaggtcacttgcaggtttgtctgccacatactagattatatcctgtctttcaaagtttaagtgatgaaaaactgtggcccctttttgttgaactaagtttcattcagcaagttattgttactgttagccttgtgagagatgagtgaagaattctacagtatacattgcaagaaatacctttaatatgataatatttttaggagaaatgtaaaaatccctcatcacatcattatggggagataataactacctcaaaatattttaaattgttcaaaattttaaatatttacattatgaatgtcaagggtaaagtaacatagaaattaaagttgggaaaaggatttaaaaatactgtcttgtccttactccaagattggaagaaaaaatattcaaatactgaaaaagtttaatactactctttttcataacacatattcagtcactatcagtagcatcagatttttgttttgcgtggaagcttagcagtgaaagcagtcatacaaatatacaatctaaaagaatcgagaactctttttttcctctgtgatagtggatgggagtataatctcacttgaacttgatatataaggagctatggatatagcacagatcaaatgaaagttagagatagtaaaactcagaggagcttgatcatgagcagaacaagggatacaatgattaaagcatttagcaaaagatagttttagcttagttgggataactcgtatctaacataatattttggataattcttctgtcttgtttttccatccagcattagagagagcaggattttatggattttattccattttccaggtgaaaaatgacctttatatatatatagcacataccccaagccagatatttgaaagtcagattgacctatttcatttgtaaactcttgaatgcacagaataattgttataagacgctgatgagcttgcagagaagacaagaatacttatatactgttggtgagagtataaattagttcagccattgtggaaagcagtgtggcagtacctcaaagagctaaaagcagaactaccattccacccagcagtcccattacagggtatatacccagaggaatgtaaatctttctaccataaagacacatgcacgtgaatgttcattgcagcactattcgtgatagcaaagacatgaatcgacctaaatgcatatcactgacagattggataaagaaaatgtggtacatatacaccatggaatactacgcagccataaaaagaatgagattatgtcttttgcaggaacgtggatggagctggaggctattatcctttgcaaataaatgcaggaacagaaaaccaaataccacgtgttctcactcatatgtgagaactgaataatgagaactcatgcacacaaagaagggaacagacactggggcctacttgagtagggtggatgggaggagggagaggagcagaaagaataactattgggtaccaggattagtgcctgggtgatgaaataatctgtacaaaaaacccctgtgacacgcatttacctgtataacaaaccttcacgtgtacccctgaacctaaaataaaagttaaaaataattaaataaaagatcattgttgcataattagagaaaatcaaatttgataagagatttgttggaggaaaattgaatcagtgaacatccctatattttacatctgaacattaagaaaatagaaaattgtgaattacaaaagtggactacatttattttatatgttatagaagtgtatgtatgttctgaccagaaaattagttataaaacacattccactttgagaattaaagaattttccattctcattttaatatgaaaaagactttttaaaagttctatactttaatttgtagtattctaagtgttcaaaatatatcttcaatttatggagtacagcaggtaagcattgaattcttatctctaaaatgtcaaatttaaggaattaaaggaacggatttattagtacagatatctaagccatagttacagagtatcattaccttcacacctttgtatataataaactaaccaagagtcttggctcttcaggatgaaaaagcagaaggattcattagcctgcctgaatttaaaattgatagagccagtgaatgccgcaaaaaatagtaagttgattttatttgggaagagggaacgatagtttttttttttaatttccagcttttaaattataggttgctcatttaatgctttcacattgaggtaataagaaagcagttttgtgggcagaaaattgaactttttactgatttctgtcaccatgatagaagcattatatatgtgaactcgggttagatgttgaggtaattttgcccgtcagaattatttggttcaaacttatttcccaatttgtaataaatgtactttgtttccttttgcagtgcattcaaagcctgtcatcctaaaatcaaaagcttttattttgctgctgaacatcttgatgatatgaacaggtaaagtatttcagagtatgtagaaggtcagtgaggcctagaattctaaattttctacagtaattcttagagaataatgtcactgaagtttctaggtcaatcagtttaaaataaaatagacccagaatagctccatgcagccatatctaattttaaagaacatcatttaaaaagtcaaaataaactcgttaaatatttttgtcaagtttaccaagaccatatacagacccaaaaaaatctaccaccaaaaaaaggggattttttaagttcatttcaataatatgtcttaaaattgactcccagatgggggaaaaagagatgtctaccaaaaaatcggactttttgaagtactgagtatttttgacagaatattcatctcaataattcaggcctaagaaaaattagtatttctttctgtcacttttcatctttcacctgacaggaccacaaccaacaaatcagatagctcagtggttacttggtggctcagggaaaacttatatgtacattttttttcttttctcatcacctaccacattctgcttcatgttaatactttggcttttatgaattttgtgctttcttcctttctctttcctttcccctcttccttttctagaattatagaaattgagcttaagattcaaaattttcctcctttctataacttactagccagtacatattacaaatataacttgcctacagttagggagaggcagcatagcatcatggtcaggagcatggactttgcaaccagactctctaaatcccagctctaccacttaatagctgtacagccttggacaaagaacatgacctcttcattccaatatagtaatgtccaatctatacaagaggtggatggggctaataaccagcccaatctcagctctacactgattagctgtgagaccttgggcaagaaactgaacctctctatgctgaggtattagccctttaataaagtgaaaataagactgacccctatcagtaagacttttataaggagtaaataagcatacataaaggacttagaacagtgcctgctaaattataagtactatataaatgtttactattaatatatattccttttatatacgttgggttcttactccatctacctttctctaaaacaattgtacccaggcatttttaagcacaaaactgtatagctgcataaatttgcttgaacatactaaatgaacacttaatgtccttttataaataatcttgttctttgacatttgggaatacaaacatgttttttttttttcaaagcaaggatatgaatacaagtaaatggcaaagaaagatggtgttgagagcacttgattaaaacttttattactaataaaggaattgagcctttcgtatagtttccataatcttctcttaattcatataacttatcattcttgaaatttcacaccaagctataaaatttaaatagttttttctccttgttctcaaaatgaaaatatttattcacattcacatggagaaggagaggtgtgatactccattttatgttttaattattttataattccactgttctagtacttactatccattttaccatatgttaagctcaatacccttgggataaatacgaagaattttcatcatgaccacactgaaattaagtggcatacatgagcatatcgtatcttacaagatggatgcactagaatccagccaactccaagaattaatacaatgtaatcattcacaatacatgctaattgggatctttttaagcttagaagttgcctctttcaaagtgcattttatgaactataaaatccttcttggccctcattacccaccccaagttagcagtagcttcaaaaggatgctgatgtcactgctctttcctaatattttgtggctgtatctggttcgggatatcgcagaaactaaaccaaatttgtgtggttcattttgttggttttctaagcaataggtgaaagaaaaaaagtgaaacattaaaaaggccgtctccacattatacatttaaaagtgctgttttatgtaaagcctgccatggcccactacaactttaagaatttaattgtcccaaaatactgaattttattttaatttaattaaaatggatttttattgttttgctttgaattttgctttctaaaaaataaccctattcctaatgtctactttcaatgggaagatttttaattacttgttaatagaagggggaaagagtcagtgctacaaatattcacagaggattaatgatggggaggaacacccacctacagctttgtcaagtcacctgactgttacataacagcaagatgatctgggtgttggtttgttctatatgtaatcttttaaaagcatgtatctaagccttcaagagattatatatttataaaaattattataattatataatgtatgtgattatttcataattttttaatatcatacctacttcttatgaaaatacaccatgtttcagagaaatatatttttctgttcctcatttaaaaaaaacaaatgtaatgctggtggtgacaggacctagtaattggtgttaaaaagttatccttacatttaattttcttctgtaaaatcatacacatatatatatatatatatacacacacacacacacaacaaatatttatatatgtgtatacatacacatacacatagaatattaaaatatcaccttctattttgagaagcagtaagtttgattgtgaggtcatttgcaaaaacacttttaggcaccccactactgttcatctgtttcatcagaaataagcactgaaacattaaaaactgatttttttcttgtctgtgtaaaatctgtggggataaaataaaacatcatagtactcaggtattctgaagacttatttactgaatttgtttggcctatatattccttaccatgtcagtacacatgttcttgtaattgtgatgactcaccaattcctatttggtaattattatttatacatttctctcatggttctttctcttatttccctccaaacacattattctttgtcagttgtgaatatctcctttgaatgtttgctataggttcaatatcaccttacctgtattttcctattttaaagcattggtgatatggtaaggtactgactgaatttagacctgctattaaatatcttcctcataaatatattgaatagattctaaattcaatattgtatctctgaccatcttacctaaaatagccttccctcatccgcagcatctttggcattctaattttctaacttgcttgcttgtctgtttttaaatagcatttgctactatttcacatatgtttatttgcatccctgtttagtgtttatctccgtcactaagatatggaaatcatgaaggcaggcactttgttttatctctgtatcccaggtacctggcacatatagctgttaataaatgttgcttgaatcagttgatgcatatgtgtctgctttcataataacctaaaatattaaattataactgtaacaagtaaatcagtaagtatcttctagtttaatcctaaaggataagtttatccaagatagcaccaacaattgtgttgtatttagccccttgtggctctacacagtggcctgagtatatccacacactttctaaacaatttttcttcaattaacaaaatttttcttcttaagaatagtttaaactttcaattgtcttgtgaaacttagtaaatctagagttaattgaaggcagaaattacgtcttatttatttccgtatccctaaaacatagcttattgttcagcacatagcagacacttaataaatgctgttgaagtgaaaaattgagcaagcccctttttagtttcctaatttatttcttaaggacctctttgttctttacatttctgataagatgaaatttcagtgtttttttttgttttggtgtgtgtgtgtgtgtgtgtgtgtgtgtgtgtgtgtgtgtgtgtgagatggagtctcgctctgtcacccaggctggagtgcagtggcacgatgtcagctcactgcaacttccgcctcccaatttcaagcaattctcgtgcctcagcctcccgagtagctgggattacaggtgcctgccaccacacccggctaattttttgtatttagtagagactgggtttcaccgtgttggtgaggctggtttcgaactcctgaaatcaggtgatccgcccacatcggcctcccaaagtgctgggattataggcgtgagccaccatgcctagccttcagtgatattttttaaagtagtaaagataaggcactggattaaaattcaatgataaatttttctttagtggtattatcatcattttcaccaaaaagcaccaggccagtctttcccaagagtggtaagatatgccttgtggtacaaatttaacccctttttcactgcaaatcaacttagactaaattttaactttgaacttttactaatgattagagtcatttttaaaacattgtcatgaagtttacttcttgatttatagcttataattttctggatgtgtgtgtgtgtgtctatatatataccatgctactgaattcatttgataatctttattttattccagttctactccagtcttttcttcacttcccaaatgtacctgaggtgataattacattgtaggttttgctaaaataaagttaggttttaattgacctattcttacaattaaagcttaaatttccatagatgcgattttgtctattagagacaggaatttcctcacttttcaagattcaagatattctaagtatctgatgcacagttaacaccatttggcataaatgatgaaatatgagtcacttcaaagaatgtgatctttcacttgacagggaagataaatgtcttaggagaaaaagttctcaaacacaattttttcttaaaaatatatctagattagattattccacaacttaatgacattaaccatactagtgattctggacatattcaagctagcttgaaatgtaggtttttcttcaatttctgatttgggaaagtatatggattatggctcaggattgaccaaagggaaatttgcatgttgtttaaagacttgtgattagataatctgatagtgtaaatagttgaaataatgaacataaggagagccctggtgggacaaaagaaagacagtaaaactgtgctttgctttaggcagtccctacattggcaatagcagcactacagaaagagcaaagaactgagatttatttttaacttacaattgctcatgaaaatacatgttcaagatctaaacagatgttaaaattgtataagttcattgtgtctttggaaaaccccatacccttgtatttagagacaagtgtccgaagtactcccaagatgtgtttcctgttagattgttaaataagcttaatcaaaactatgatttcataataaaactattattttgacaggcaaggtccataacttttttccctcatcagaataaattgaacctgatactgtttaaatatctctaaaggagcatttgctctgaagaaacagaacagcaggaatatttggagtacttctacatttggaacaatagaattaatatggctttggtcatctccaaaccctttatgttacagatattaacagctttgcccaagacttttctattgaagtagcatctttggtatgggagcaatttgtactatagcaaattgtatctcattaaagattctatgtatcaatagtagcaaagaacacatcttatatgtaggattattccgtatattcttagacattttaaaataaatgtttctaggaagtaaaatataagaaattaggttacaatgttattgattttaatatttgttttctcaggtggcttaacagaattaatatgctgactgcaggatatgcagaaagagagaggattaagcaggaacaaggtaaaggaatacttttttaaaataattatgttatactttttttcctgcagttatcctatacagaaattcattgctatcacttgagagaaaatacatgtcaatttttggttatttctcttctaggcacttaagtgaggtttaacaacttatatagatagggactgaacgctcaaatttttggagcagctagtgtggagttctctcctatttgttaccccctcctcccatctctttcctatgaagaaacaaaatcttaaaaatggaaaaagtctataataggtcttatgattgaaccaagtccagatccttagcagtgagcaatttttactatttagcagttttatagacatttaagtggccttttatgcaaagaaatgagatgatcttttctttcttaaattttctcatttggtaatgttcttcagctctgttactgtgtaactctgtgatcttatggaatttgccttggtattgacctcagatttatgaaacacagtgttatggtgcagaattgaaatcttaagaacaaaagctgtggtcatcgttcttaggtggcttcacatttcccaaagggtgtttgttgtacatcccttggaaacgtaaataggtttttgaaattatctgttaaaagaatccacagattgacatacttataaacacaaacctattcgtagttgtgtcttcagtgggcatagccagtttattgatgtggagattctaaaagccttctgtttccttttagacttagagtaaaatctcagccaggttttgttttttttgtttgtttgtttgtttgtttgtttttttgaagtaacgtctcactccgatgcccaggctgaagtgcggtggcgtgatcttgatcttgactcactgcagcctcgacctcccaggttcaacgatcctcccacctcagcctcctgagtagctgggaccacaggcacacaccaccacaactggctaatttttgtttttatttttgcttgttgttttttgtagagacggaattttgccatgttgcccatgctggtcccaaacccccgggctcaagcgattcaccgatctcccaaaatgctgggattacaggcatgagccatcgtgcctggccttcagccaactcttttttaaaaaacacctgaaaactaaagtttttaaagatctaaagaagacagccagatcccaaaaccagtatgtcagcaaatgtttaggcacagattagtaaattttttctgtaaagaacctaataatattttgggctttgcaggccatatagtagagactatatgttgcataggcctaaatttatggtaagagtactgaaaaaaaattagtgttccttttcagatttctttaaaaggaataaaacagttctctgcagagactatacttgcataggcctaaatttatggtaagagtactgaaaaaaattagtcttccttttcagatttctttaaaaggaataaaacagttctctaaaagtgtttatagatttttttctgatttgttaaagacaagaattagaagtgtgggcaatgtactgataggaaaatgaatctctgactcaatttgcataaatataagggagcttggttcttaggcttaacttctgtattttattacttggcattactacgaacctgagcttcatcttgattttagtgaacttcctttgtacttggtattatatagccaaattttattatggatgaaataactggtaagctatatagttgtattggacatgcaggttccaaaaagtatttagtctgtggattcgtgatgtattggtctatcatgtaagtagagaatcataggcagaagctagtagttacaatttaatgcaacaagaatcttgctaatgcaatacaaccagaatctctgaaataattttgatttccacatagaatgcatgttcctcagtcactttatcataggtcagaaacatattagacttcttacctcctgaatgattaggttgcatggtattccatgtagaaaactactagatgcacatatctacttcacccttctgtagagttatttgagtagagttatatcttctgagtaccattctaagtaatgaagataagcttaatacaaaatatagctctttgaggactgggaatgtttctccacaatggagggacatagctgccagatactgtttccatctaaatagccagtatagcttagaagtgactctttcattgacttaaataaaaatttagtgaattgctgtctttgattacagaagtataaaagatgtggggttctctttcaacatccgttgttgtacttagagaaaacagagttacacttaattcagctgccaagatagcaatttggctaattgtctactgatcatttttgtattttttccagcttcaagacagacattcatgacattattttcagtcacacataaggtctttttaaagccttaatcacacacaaaaatgaatgaaatatattgtatttcttcgacagttctaaatgaaaaagtcttttttttttcaaattatccttttgtgtcaacatgagaaaataaagtagaagttttcctcttctagtgttggcactgctttttcatgattgcttataaaattgcgtatcattgaaagagacattaaaagtatccatttaatttgtgctatatagacagctaagaaaaataaattaatttgccattagaataaaaatcagactagttttcatcctctaagcaacagtgtgtctctaattttccacacaaacccaaaagagcctaactgaaatttctatgtagcctcttctctgtcattgctctctcaaagacacacagcttagtgtaagaaaaaaaattaatttgcaaagtagtatttcagccttttcttaggcaacccaagaaaactttggattgacgatgattgaattgaacaatgagaacacttggacagtggaaggggaacatcacacaccggggcctgctgtggagtggggggagggggaagggatagcactaggagatatacctaatgtaaatgacaagttaatgggtgcagcacaccaacatggcacatgtatacatatgtaacaaacctgcacgttgtgcacatgtaccctagaacttaaagtataataaaaaatatatatataaaaaacaagaattccatcaaatagtgggactaaaattcttcctaatttaactggaaggaaaaagtagagaaggagccttccaaaatctgtcacttgtagtgacagctatggaacccttgataaaatcatgatcatctccttagtgtgctaataaggaccacttgaggtattaacgccttgaaggcatcagtgcaaacatcaaggagatactctgcacaggtgccacagttcctggaaatagtgggaagaatgctggcagggtgatctttccttggcaggggcgggtttgcttattccatttacctacagggtgatttcccagtagtatttcaagctctcacaaaactaccaaacccaggccccaggactccagattttacttttcattgctgggccttgctacaagaaaaactttatgtctaagaagaagaacaccaggcatttatttcttatgtgatctaggtcacactgtcctgtcatgctactacaaatatacccaagaagataagcagttctaatatttattgagtgctatcaagatgcaaggcacttgaatatgtttccttatttagtgcccacacacacacaactctgaaaggcggttattattagaccccttttacagataacaaaacagactcagagaggttaaataaccaccacaagagcaccaagatgggaagtggtctagctaagattcgaacctacacctgtctgactatatagttaatgtgtttttccatcagcatttgctgggtccgtttctgggcaactgtgccaattcatatttgagggaaaacttggtatactggctgtcactggcatgaaccaatggaaaaaaaacagatatcaaattaagattaactagtctttgcttatcttttactcaaaaggaataattaaagcagcaatagaattttcagagtcttcgtattttgaggcctgaatatagttgagaatgtattttatttccaacttccattgctgaagaatttatgttcacaatagccggaggtacatagcaggaggagatagggggataaaatgttcatcaatatacacatcaaactctcctgctatactttacaaaagagtcccagcaacttagtctccagagctttagggtaaggcagtttcttagttcaaatcccagatctattactttctatttgatatgtagtaatttcttaatgtatgttagctgtaattatcattaatattaatcagcactgcagggaaaccatatacaaatattacaatatgggaattcgtgggtggagaggggttcctgtaaatatacgtgccatgattgttcacctaaatgtgaatattagttaagccttatgatagttcttttgtgatttaaattttcataagaataaggagacttttgttttaatatgttttttcttatcatctgaaattgatggataatacttcaggttttttcttgtaaatcatataaagaataaaaccagcagttacagggtggttggaatattactggaacagattccgattattagcccttttgctgcatttgacttactctagtaatttgaacttctctctcagagttctttcccctccctcttgcctgaggtctgccaagtcactttgtctagctgcttacatttgctacccttttaagtagttctggaagtttggaacttgcagcccacatcagcagatttgcccttttgcatttggcaagaatcagaatttgccatgtgtttccaaggagaggtgggagtatggtgttatagagattcatgtcagcatgagtctggaaacagtgattgttagataatcagtgaactgaagccagagaagagaattgagagcattatttttagagttgtttatatctgtagagatctacagcaatgtatgtattgcttttctttgaatatctttaggataaaatgatatacctttaagaggcatcatgtgatgtcattcattaactgaagcttcagaataattgggtctgaaatctgaggtaccctaaacctgactgagctcatgcagtacgttctttttaactctctaaaattatggctgcatgtaactgcttgctttaaaaggatgttagaattaggtgattgtacacttactttctcctcaaaactcaactgaaaataaaagttggtaggccaagggtaaggtagtgctggggaacatgatgttggaacagaatttaaatttcctttttttaaatgatagtttatgttcgtgaaaatatgaccagaaacatttagtagaatgttgacgtatccatgtctgtgaattttcagattactggagtgagagtgacaaggaagaagcagatactccatcaacaccaaaacaagatagccctccacccccatatgatacatacccacgacctccctcggtaagttagcaacaagaacattacttatcaccagattcttctacctgaaacatccttttgtatgttaaaaacatatgtagtagattgcatatcaaatttaaggtttctcagcggaaaagaaaactgggagtctaaaatcaataagcaaatttttttaagtatacaaagaatatttaagcaggaaaaacagtcattacagattccaggcagaataaatatgtcatcacttttattaacaaaatatactgtttgtatgaaggtagccttcgtggagataatcaacaacaacaaaaaagttttcttagaaaaaggtatataaaatgaccttatctattccacactaataaagtgtattcctatgtcctttagaatgaactcataaaaattaatattatatctatattgaagatatttttgcatgtagctttttcagcagccatgggacctggtttaatgtatatgtttgtatggtgtgtcagacaaatctctgtaaattactctgtgtatagactgtactttgatcttttaatagggtaaacagctggtttacttgggactgtcccactttatggccctttcccatcagaattaccaagagtgtctcagtaatgttccagtttagacaataatattccatggtcaggccgggcatggtagctcacgcgtctaatcccagcactttgggaggccaaggcgggcggatcacttgaggtcaggagttcgaaagcagcctggccaacatggtgaaaccccatctctactaaaaatacaaaaattagccaggcatggtggtgggcacctgtaatcccagctactcgggaggctgaggcacaagaatcgcttgaacttgggaggtggaggttgcagtgatccaagatcacaccactgcactccagcctgggcgacagagtgagactgtgtctcaaaataataataataataataatattccatggtcacattgccataagaaacaattctgcctatcttgggactaagtcttccacataggaaatagaagctggatttaggtgacaacaatagctaacctaattccatctcagtattactccagggggataattcatattttctctctttttctaaaacgtcaggatctggacaatttctttaaaatatctataaaagaggaagaataggaaacagcatcttcactgaacagctacttaaacatggcaatttgtgaatttcaagaagaaaactattcatattattattaacatgtgggaaggtaactgactgcccgcagaggatgccaagtaacttctcctcctttaccaggaggagtggtatgcagcttcacctcagtccggtgtgtcctggctgccacctcagccctgtttgtgatgatcacatttaacaaatcaggctcgacctgggccggtgtgtttgttagtccccagagctagagtaaggcttgtggcagtagaggtgcctgcaactatttcacagtgttcacttgatgccagtcctttttctggttatgttttgtgctataacatatagtcccaagctttaaattccagggataaaaattttccatttttcttttatatttatgtgccctgcagtatctatgctcaaggctaatggtaatccctagcaatgtatagtctcatcctgcctaacatttttaaccccatagaaagtaagaccatcagacagcttttctctggcacccataggagcagacattctcctatgaagaaaaggaagggttctttctgtttataggcagcctatcctcatatccaaaagactctctcctagtccccaagcccaagctacatgaaatcaggaatatgaatccagggacaatacttcttcaggatctgaaaatgtatagtttttaaagtgaaatttttgtagttgctgaattttcttatgtaagcactaactcttatacttgcattgttgtaaaattttgcattaatatgtcagatttttcatgagaccttggtatagccgcattccaatacatccatgtctctgtctcttaaaatgtaagctggggcctaactttgagatgtctgcaaacttgcctagtcattaacatgactacgtaagagttcatctacttaaatattacctggtagaaaccgaatgtgttccttggaatggaagtggtctgttattttggcacagactaatcaggggctcctttctacagatgagttgcgccagtccttatgtggaagcaaaacatagccgactttcctccacggagacttctcagtctcagtcttctcatgaggagtttcgccaggaagtaactgggagcagtgcagtgtctcccattcgcaagacagccagtcagcgccgctcctggcaggatttaattgagacgccactgacaagttcaggcttacactatcttcagactctgcccctggaggattctgtcttctctgactccgcggccatctccccagagcacaggcggcagtctaccctgccaactcagaaatgccacctgcaggatcactatgggccataccccttagctgagagtgagaggatgcaagtgctaaatggaaatgggggcaagcctcgaagttttactctgcctcgagatagcgggttcaaccattgctgtctgaatgctccagttagtgcctgtgacccacaggatgacgtgcaacccccagaggtggaggaagaggaggaggaggaggaggaggaaggggaggcagcaggggaaaacataggagaaaaaagtaagtatgtttctggagattcttagcctgtgtacacaaagtcctgaccttttcaaacttcttatttgaagaaaatagaaccttgcttcccttttttcttaaaataatagtattgctatatagtaagttaggtctcccttggtgacctactttcagaacttcagtaacttgggaaaacatgatgagtaatgaagcttataatctcaagatacccacagctggagcaaataatttttttctccaactagccatttgccttttaaggttaatggtgtttttgttttcttccttctcttatccactttattctcacttgcatgcaccatctcactggcccacagtggttgccccctgagttgggttaagaaactataaatgtttcaagcaggttgttagcagagccttggttgaataactgagtatacacacacacccactcacatctatacatatacatatttatcttccctttttattgtcagaagatttaaaggaaaaatccaaaagatagtttttccaaggagagatttcacatagcatttctttcaactccaaatagctgaatttgtttctagaaaccaattttccaaaagcatccatctaatttcttggtatgtgtgttgatcgtaaagctcaatttatgtgaatcaactcttataagaaaagtcaatgaagtaatcctctgccttgttgacattaagaatatctttactagttattaagttctttattcaacatgccataccaagcctctgtttattactaacatgacacatcagtccagaaacccaggctggtttaagggaaaggctgtaactcagttattttagtaagaaagaaaatctaggtttggctacaagtcctgaacataaaatgcacaaaacaaaatatatagaagaaatagtataaaactgttcacatctctttattcaaaatgcagtctgggccaattagcgcagataacttgagcaaatggtgatgaaatcacagttacttgtttggtacccctagggcaatagacttctctttttaaaaagatgaaagcagagtgtagccttcagcccattttacaaatatatgggactttgattacagaatatattagtgtaagttcttcatcacaaatggaaaaatatctcaaagttcacagattaccaacaggtcaagagccccatgtcagtgtcaagcttggctcatttaaaatggtagtctctttggaaatgactgacaagaaaatacagtggacctccctttatggtgtggatcttcattgcattatttaatattatctcatctaccaacaaaatataagaattgcttgtaataaaattcatatgctgtggcagtttccatgtgaagtatattttagccataatctccatgagaaacattataaaaggtacgttgttagtacaggaaaagtaattaccattcattacttgccaagccctttcaacattcacatctatcagagtttatggaagaaatatttaggagccatgttagtcctctgcaggaattctggcaagcataataataatgtttaatattctaaagattactaaaattaataaattgtcttctaaaatttaaagatgagttagaaacttcatttcaactgtcattcaggtactacacaactgctgtgactaagtatgtgaggtttattcttttacaaacattggagaaaacactttatctcagccattttaagataaactgtgttgaaattaggcacagccctctgaaatagagaattctgttcagaaaacatttcatcattcctacaggttaagtcactaatgttgtcttgttttgaataagctaggcacttaacagttcatcctggtcattgaataagggaagagtagaaagaagcaagcgtgtcctaagacatgaagggaaaatatggcaccatgcttgctcattcttcaggtttccagtagtccacagagcacttctagttagatagctttcaatttttttcttctagattatcttttttgttgtttagtggattggattttttagccaaatagatgcactcctaagttggttgggttttttctttacatttcagatgagtttagtgggtagttattcagtgctttccatctttttcagtgggctctctgtagaataattgttataagatagaacagacctagtaagtgtgtcagtaaatttggtattgtactttttgtctttatggttcaatattgtgggatgtttcgtgctatttcagtcagatctgcttcactgaaagtggccttgcactgtctttcaggccccatttctttctgggtattttttccataaatcttgccacttgatttctccgtgtacttcaaactgttcgtaacagagtagtgcattcatcctttcctggaagatgcttattattcaatgaaatgtatgtttgttctaatgatggttttctgcattgctatttctaatatttaggagtgggcaatttgatgaacaccttattcaggaaacatcagctttaaaaaccagtgttttcaaaagaatctttaaggtctagttatgggatgtcatgttcatggcttccctggattgaccattaggagtaagtactcaggctgcttgttcaaatcaagctgtctggtgttatgtcagcagagcaaaaattatacacggaaacgaagctgtggccattacatcagccttaacgtcctgtacatgtcctccaacacagagcgcttactgtgctgccacacagttcagcaggcaacctgtgcttttaaaaatcaaagtccaacagcagtgtgttacttactgtcctgctccaggccagcattcagtttgacctcctgaagtgaattgtagtcatcaagtacagaactgcagaggaaataagtttaatgtctagttccaaacgtttttctcagtttgccaagaaattaaaaataggaagtatcaggtggccaaaagaaataatggaagaaaacatgaaaatatagtctgtcatatgctttaagggtgaagaattatgtcatcaaccaaacctctttcttatcatttacgttttatcttaccttatatcacaatatatgttatatagtgcttatgagcttacagagcaatctaagaagcaagatatacctaaatccatgccttagctgtttttcattttccttatgggtatggaatttggccctgcttataaagtatatatttagccttccttagaacagacttcaatctgtgttctcgtagttgaactaccttttgccttattttgaaattcaattatttaactgagtcatactgtgattttcttaggctgaactcattttagtctgaaatggatggtactaaaagtacacaaatgagacctgtcttgttttcctttgactgaaaagtcagcttgcatattaattgtcttgacctgcttcactgacatttgagaaaagacaagtaatttcctgttatcccaattagcagtttcaaaccttacctggtatggacattataagacatcagctaaattaacttacaaattatgtcattctatgcacctttaaaggaatataaattatgaaagtatgggacaaaatatgaagatatatttcattcagaaataatctgccataacattaaaatactattttggttaatacagcttgaagtcagcttagaaaatctcgctttcctttgccgtatgtactagccaattcagatgaggttttgaaaaccattatcccttaatcctgctgattttcccctaagcaattataagggaactctcctggactcttgatgccttcatttactcggtgaagtcatgatgtcctttatcattgtcttgaagattacctaccagtattctcacttaatttacacgtatatgtagcttgggcttagaaatctaaagcaaaacctaggtcttttaagggggaataaaatctattaccttggagccactgtacacattagattatcaggctgaaatattattgacactttcaaaatgagatctgctgagaaatatattttaaggttatttttaaaaatctagactgagttttgtggctcacgcctgtaatcccagcactttgggaggccaaggcggaggatcacttgaggtcaggaatttgaaaccagcctggccaacatggcaaaaccctgtctctacgaaaaatacaaaaattagccaggcgtggtggcacatacctgtaatcccagctactaggtggctgagacgggagaattgcttgaacccgggaggtggaggttgcagtgagccaagatcatgccactgcactccagcctggatgacagagcaagactctgtctccaaaaaaaaaaaaaagaaagaaagaaaaaaaattagccggtcttataacctgctctataaataaacaaaataaataaataaataagtaaaaaatctaacattctttgtacactattaataacttaggagctgtgtagaatatgccactcagtagcctaaaatcttaaattattagggcataggggctagattatgagtacaaatacagagcagaagatacattaattcttgtcaatcattttaagggtcctatcttcatttcctgaagattttctaaaggtcatgaattctatttttaagaacattaaagtaggagatatgtagacaaggagaaggtattcccagaatatgaaattgtattgaaggaagaaaaggaacaagttgaaaataaaaatgttgcaacacttctcacttttttattatcaagataaattatatacacacacaaataattttaaagagcataatcatcattaatatcttaagttatagttcatgtctaaagggagtagatggagaaggatatacacagtgtgaagaaaaagacatgataaagtcaaagaaaaaatggcagagaaccttaactatatcacttttgtaaagttgagcacaccatccttggctgattatataacaaatatgtatttaaaaaaaacagaaaaacctagaaagtagtgagaaaattattttaatatattgtctgattttgaagaaatactgttagggagacataaaacactgaagattagctataattctgatactggttataggttagatttttaattacacctccattttttggctaaaaaaatgagagaaagttattaacttacaggaagttcagaggtggggttgttctggggtgaatttcatggcttaccaatgtcaggactctccattcatttttctgtaatgcaagagctccaagcatcatttctcatgagacagcattcaaaaagccaaagaccaggccctatctttagtcctttctataagaccaagggaaactttccatggatccttccagcagacttatacccagatttcattgccaaggttgcatcacatgtgcatgcctaaacaaatgacaagggaaatggaatgatatgaacagtttagactaaccttgatttgtttttatggtgatgagaaagagaaatgtgcaaaactgcttatcattactttctgcatgagcagctctattactgtgtatgttttgtcttcaaattatatttgttcaagcagtgtttcactttttaaatatatatatgcacatgcatagcccagatcacatcaccttacttaaaaattttggctctattgaaatgttagatatataaatgaagtaataagtattatgtaaccctgaaaatgtagcaagtttgatataattattgttgctcatggaatgaataagcatgttttcctatagacaataagtaatcctagcttagaatacagtctctggagatattcctcagttcaaatccttgctttgtcactgtcccacttacaactggtatgattgatcaagttatttaacacctctagacctcaatgtcttcattgtcaaatcatatggtaataatacctagcttttgaggttgtgtgagtattcaatgaagtgatgtcagaaagcaccttagatccatatgtgacacattataagtctgtccagtaaatgttatatagattttatataattatataggttttatatttgtttcatttatagattgatataattatatagattttatgtagatttgtattaaggcaaagcgggcaattacaatacttaaatagtgaattaggcctggcaaacctcattaagtaatgtttactacatgtcctatctttgttcagttctagccattgagttgaaccatacgaaatgttgcttttgtaggtcaaaatgatgaaacattagcaattttgtgtgtttcaacctaacatattagctgcgttctaggagtaaaatagaaatgttcctcatttcacattcctatcactcactactcctttcctttttgactttggacatttgggaactcaaaagaaaccttgcattccaaatagcaataattgtatcagatatatttactgaaatgtttatttatagatcttgtcatttgggtctcatttcaaatattttcccctcagagatcctttcctgacaacccagtctgacccagatgcccaccaccaccattcatcctcttgtatggttaccctgttttatatttttcccagctttatcactaggagtataatattaaatattgttcacagatttattttccatccctactaccagaatttaagcttcttaagagcagggattttattcctgtcttatagcacctaaaacagtatatggcccatagtagcccaggcactattgaaagaatgaatgagtgaatgaatgagtaatagctaaccccttttgttactaacttcctttcaattttattatttatagagctaaagttattttatccaacatatgacataaaacaaatcaaaacatcgcagaattcctcatttttggtattttgtcaaggaaaagccaggactacatgtgttcagcataccctctttatgctggagaccacaaagctgggatgctgataactagaattactgctcctcacattatggctgttttatggtcacattctctatgattgaaaccatttcctcctgtttcactgccatttcaaaaatgaaggccacaaaaatatgacatctgaaataactagttcattgtcataaatcagttagaaaccagatcttccagctctcttaggcagttgttcttcccaccaaaatccactgcctgtagaaggaaggaaaactcaaatcactgccagtgcttggttaacactcctagtcgtccattacctagcttcatcttaattagtttgtaaaaagtgttgaaactgcaacttgtactttggcaaataaccagtagccctgcatcagccaggaaaataatctcaaaagtgttagtaagtaatgacatcagatgtaaatggcaaaagaaggaattctaaatgctgtcaagtcacaacagcagaagatgtggccagaagagagctaatgctcacacaaaacaatgtcaacccctcactagcataggtaaggcaagttatgatttatgttatgttatttttttttactgagagagattattagattcagccacactgttatctgctattattttcacacatcaaaaaaaagcaaatcacttctcttcagctcaataatagcatattattcatttctccatggagtaccttctagcttattgtataaaaacctatcattctctttttaccttgctcacccttgccagagaaggccgaaggtcacaaatgcctcatttttgtccctcagcataaacaatttacctcctatggttggttaccaactaccagaagatggtagattatgatttaatatgattgcaccataaaaatatcttggagattttttaattaccctatttttgttgtgtaattcaaaagtaataacttgcttattgcaaaataaataaaaagtacagtgatgaaagtgcaaagccaccttctcttttctttactctccaaagttaactactgtcgaaagttaaggttttaaaaatcaattctggcatgaatttattttccttatatatctctatcttgtaactcagtgtgagttagggatatgaaggatggtttagttgattatcagttagagttcctctaaaacttttttgatatggcgttagtttataatgtaagcaacagtcctgtgaaataacttacgtagcaccttagaatccagcccaatcccaaaatttattactctagaaaatgtagcagttgaccttttcaaaaacaataggagaaatatgagaagaaagaaatggcattggctgtatatgcacactcactcatacactgccccccccacaaacacacccccccacacacacaccccgactcatacatcagaagttctcttgcctacttgcctaatgccttgatgccttatggattttgctgagctttctttatgaagatcttccagtactttcagtttataccaaagctctgtgatgaaagagccaagccagagccaattagaaaaaaaattagcaagtccagccttcaaaaggcagaaagcagaacttggatatgggcttcatagccactgagtctggtgaccagtttacctacggattttagcttcaagttataaaacactgaactttctactaaacaatctctcctatttccagtgttctcactagtttcatactactagccactcagactttcttatgccgtgccgtaggtacatcttggcctaatatttggtcttaataacataatctattacactctaaaatttgtcctttaatgggaaaatattcccactactatgtcattcaataaggaaaaagtgcccattattatatttttaagtggaaaatttgatcttaaaaaattaatagttaaacctcatacttgaaaacttagagcagcttcttgtctcaagaatgacaattttgtatatttttgtttttattacaaacacaaaatatgccaataaaatcaactttctgggttatttcacagacatttttggaatacttgaaaataagagttatagttgtgtaaatcactgattgacttcagagcttttagagccacaaactctttaacattcttactcttagattttctgacatttcaatatctagatttagccagctaaaatgcaaactaagtctctgtatcgtacatatggtttgctgtatcaatatataattcagttaattccaaacatgcattcatgcattcaacatgcatttgtttatttttctacacacagggtaccatgttaagagcctgtctagctcttccataagtctacttacaacagaaatgtgtaaattatttttaataaatgagattttttctttctgataacatgaaacacagagagtaattccaaatatgcaacatctttgttaccttataccagtaattttccctagtaaccagtttataattttataaaaattattcattgagagatggtgcaagatattttatttttatgttaattacttatcacttatgcaaaatttataagactagttaaaatcagatgagatcacttaaagagctatttctgattcagcttattccttaaacatcatggttgaggaatatgcattctggttacccagttgtactgattaacacaaatcagatgtctaaaaatcaatgaactgaacttcatattatactgaccatagattaatgtttctttttataattgagaaggcacttcttaatgttacactataatcattgtagaattttattattggaaaagcctattaatatagggaatattagcagagcattaaatacagaaaattgtattttgaatgtctattttagggaaatttgaaccttaaaattttaaatagtttttcatttccttccacatttgaaatccctaatcttccatgattttgaatctgttacttttactgcactatttctcttttgataaatcatccgtagaatgtatttacttaatgcctaagatctattcacttaagacctccgaattttctcatctatgactttattggctattttcgttataatttttttttaatttttgttgttgtggcccctccactgctccatgactgaatttagtttattctgtaacttacgaaatggacactgtaaagcatacaccttgagattcttggtgagagaaaatagcccataactttgatgtcactaaacttaaactgtacacatttttttcctatcatctctaatgttttctcctgttctttagcaatgccaacacacatgggttcacatgccttttcttaaaaaaagaaaagaaaagaaaacacacggggaggagggacagctggaatcagtgtggctttaatataatacataagcaaaatctgacaataagccccacccctcactttgaattctgttatctttttaaaatcctatgtagttgctgggctgccttctctttatttagcatcttgggttcttagattcatgatgtgcttttattgacttaattaaaaggattttgcctcagcactagaggtaggcaagatgtttatcattacaaaagtaattccgtagaaatactgaatagctttgctgaataagtaactgaaaaggtgccttaactgaatgcttctttaaatttttaagcatctttttttaatgtgtcagtggtatctctctggcaaatggtaaatcactgatttactattaaagatgcttaaatttgtaagcatctttttttaatgtgtcagtggtatctctctggcaaatagtacagtacctattttaaaatgttttatgttaagaaaaagggttcatttaagagatgaattgtttttaactgggcttggcatggaaaatgagtcatgctgtatgtaaatatgcatatagccctctcaccatagaacttagagttttgaggcacttatcttcactttctacccaaaagagaaacttttgcatattttaaaaattgttattgagcctctgcttgaatattttaaagactcggaactcccgcctccaaaagcaggcatttcatgttgaagagccttacttacagagttcttccttgtattgatacaaaaacaaatttctgccaaactttctactcattgtggatcttaaaattgcaaattagaaaaatgcagagcaagcatttgaaagcctatcatgtggaaagatggacaagatagtctttgaagttccagagaacatagtagataaagggcacaaggaggctgattttagattgatatggaaaaaaaatccagtttttgcaggtttataacttacgagtttagtgggctcctcattactcgaagtgtttaggaagaggctgaataaccagctaccagccaggaattcccaagttagctggaaagttcaacctgatggtttcttccaattctaaagttttatagttctcttcagcataatggtcttgccctttgctctcaccatatgccttgcacattgtatatatctccaaaactctaaaatggaattgtgttatcaaacataatttgtgttgtctcttcttgaggtgtctttatgcctgtgacacatgagttctagataactcatcatcctggctaccctcatctggactccttgtttctttatagagtccccatgctaagtgtattggaactattacagtgatctagacactatacttttgttaacatgattacattagttttaacctgctcactgttggctcatataatgctttaatgttatcaagtgataagcattccacttactttattttttaatctaagtgcagctatttatatttatttctgttaaatttttaatgtctcatgtttcacccaaagtatttgactctgttacaaagtttagaatctcagttttatcatgtatgatattactcatttctcttatcatttaataatcctccaaaattctaagcaccctttctgtgtttttaactgattcatcaaggaaagtacattttttaagaaaacattttaaggaagaaaagaccaaggacagagatttacagcattaaattttaaactttttgtgttaattttattcagtcattcaaagtctttatatagatccacctaatagtaatgtcattcagcccatattacagtatctttattcatagggtatcaggtaaaatttcatcttatgtaagacacactgcccagggttttcctcttcccttccaacttagagatactgtccccaaaagaagtcattttaaaatgcttcatttttttattaaattcatattggtttgtcaaacgaaattaaaaaacaaaacgccacccactcatcatctatttttacaaatttatatttatatcaggtttatcaatatgttcattggagaactcatgctttgtttgtttggataagagggctcttaagatttaagcattaagtcttatggaatgctgacagtagccctaagataatttccaaaaagtttattcacttgctaagattataaccttctagtttaaaggaaccacagagtggttcttagtagtcccttgtctccagaagcatttatgttttaatgccctagtttgaagactttttctcttgcaggaaaagcctaaattgtcattgaaggcattatagttctactttttatcattgatattttcttaatttttctttacaaaagctttgtatcttcagttttttcataagcttcagctgaacatttgcctttgtggagctcttcttacaaacaattggtattattttctacttgttcatttctcgtagcctcttattctatattttatagaaatcctccttaaactaaggcttgttctaaagaagttccttgtaactaccttgacttcatctgcatctcctttccctccctcattgggacagtttacgtttgtattactggaatttaattttttaaaagtactgatcattaaaactttccatttgtctttgtaaagttttaaaatcatatctttaataatctaaggtccatatccagctatgtgttctttctcctcaccactagaagaaaaaacaaaagcaaaattacataatgtgtttcttttagttctctttgtgccataaaagttcttccctgttgttcagcattagatcccaaatagattccaaatatttctttgtatttctgaaacatgaaaccatcagggtttaaatgcatgcagtaattacttacatgtattgatctcattttcaatgcattaaatcctataattagtatattgatggcttgaccagaaaatattgaagttcaggttatattattttatattttttcatcttcagaagattttatagaaattgattcaacttttagcctacaaataataggaaacatgacactataaaaattaggtgacttcattaggacaatttacaatatttttaagcctgtgttcttgcatgcctcagtcaataccagaatatgtttgtatagagtattggaaccctacagacctggttggacttttacagatctagtaagagtaagaaaataagagtaccatagatttctaatagtttgtttttgttagatccaagtcctaaccctgatcagccatattctttagtcaactgtattcagtggctcctaagaattatcatttctatactatgccccagtttacattctttataaataatagcttcaaattacagaaacaagttgcattcagacttcttcattttaagcccttttacctaaagtaataatgacttggtagtataaaactgtactaccaatttctgctctaaagagcttatagaaattggggtgatatttgagtatttgtttattagattatcttgctgtaatctatctagtgcaagatacttgctgcctgtctgtaaaagaaaagtatgtttgttgaaggtaatctcttccattatatttttagaaaatacatagtaacatttcaggatgtatggtttaatgaagagtggtgttgcaccacattgttgatgctccttgatattttcacacatagccagtgatatacctctcccaactgaataattaacatagctgattgtaaaaataaacaaacttgatttagcccttcaaaatttatttgcctgtaattcactgagcttatacgtattaaacaaaacatataataggtacttcattgtcatggaacccaaactaaataagtattaaataaaactcattcacggatttataccttacaaaatactgcatattgtcagaagaagaaaggcataggtgtccaaaaattggtttctaattaattataatatggataatttttttaaaaattgaataacttttttacaattccagccaaaatttagcatgtcctccattatatggagcagtgaatttaaaaattactttcatggttttagagtttgagacagccaaattacacaaatgattcactgtttaaacatcaataatatttccactggtggcataaaatcaagcttcaatttctaaaatgtgtatggaaatcctatgcattactgatatttagaactacctttttggtatattgagatgattgatattaatcaggagccctaaatcagttgataaactattttcacaaaatgcagagatattctattttactttgtgccttaaattttaaagaaagaaagaaaacaaaggaaaaagacataatttagtttgttttacttgacagtcagcaaaagtccactaagcagggtgtggctatcatcccaaaggtgaataataacagcaatcataaactggactgatcatatatctgaacaatgcctaaaatctcaagaaccatttattgtacttgcaattgagtgtagtgtttaaaatgatgagaattttgcctacaaaatcataattcctgtggataaagaatgggcacaaactgctatttttctctaatataaaaagaaataggctacctctaagtttgtttttttgtttttttgtttttttttgagacggagtctcactctgttgcccaggttggagtgcggtggcgcgatcacagctcactgcaaccttcacctcccgggttcaagcaatttccggctaatttctgtgtttttggtagagatggggtttcaccatgttggccaagctggtttcgaactcctgacctcaagtgatcctcccaaagtgttaggattacaggcatgagccactgcatctgcccacccctaagttttctatcatgattgttccaaaaggtagaattatgatgtattaatttatctgcctaaccaaacttttattctattcattgcacagtttctaaaatcagagattatcttaaattgacaatatctgacatatttctatattatcccccaatagctcataattcaggtggttgtaacccaattaaatgatagaagccatgaggcttgactgagtaaggtagaatactaattcttattttttcattgtctctaatgaaatgactgactttttagaaaagccatttaatttacccactaatattataaggcatcagatatttttagagaatgcttttttagaatttaaactgactcagttttcaaaaaaagattattaaaataaatgcacatcgtattctaaaagtaaaaataaaataattcaactatttgggtaaaatttggtgactctttttctgttaaattttcaatatttgatggaaatgaacatataatacatgtaacatggcattttaaaatgttaaaacagtaactaatggttatgtcacaatcatatttattttgcctgatccatgtggtacagaaacctagccattcaaaatctgtttaaaggacaaagttttacacatagcaataaagctgtatcaagcaatttggctgcaaccccttccaacatttccccaaagtagcagggtggtgaggttttttatagtagttccatcaatctgcttctatcaacagagaaggacctttagagagtatatttttaagttatatttataattaaaatctcatcctgagtctaagattttgtcttacctcatctactcctaacattaatgacatatgaatatcttgacaatgtaggtcattcaaagaaaacaccctttagcagtggttacactatcatttcatataaggccaaaatcatttttccttgacatagcaagcagtgctagaaatagcattctttgacctcagtgacttatcttcctaagatttccccctctgctacatagttcaccccaaaaactttaagtagatcttctcacttcaattgaaaacctagtgaggtataaagcattttacatagttgtttaatagaagtctattcagtgttcagcttgtacccgcaaatactgagattttgaattaagatgtatttgggcaatttaattaattcaaataatatttatggaggcaacacagtgtcctgagtacccactctgctaagtgctggaagaaacaaagattttaaaattacagaatcaataaattcatcatttaatgggagagaaaaacatacaaatgtaactgtacagtatattagatgttttgagaaatgaacacattaagttctatgaaagcacttaagaggtcttgattatctctaccttgtgaaatcagacaagacctcacagaggatgtgacattcaagctggatgaataaggtttcaccaggagaaaaagaaaaggagggtacattctaggtggtaaaaaaaaaaaaaaaaaaaaaaatggcatcagcaaaggtagacaggaagaaaaacaaagaataatttagagaaatatggtatttagtgtagatgagtacagatgagacaaagatttatgttagaaatgaattaaaaaggtcctaacataccatgtttagaagtttggattgtatcacaaagaacatgatagagagcttcggtaggtcactctggccaatatagatgtattaatgtgggagaatacaggtgatagggataccaattagaaaactaattcaacaatccagatgagagatatgataccctcccttgacaaatgtggaggcaaaatgttaccttctcagaggaagatctaacagatagaaagtaggtcttgaagagtaaaatggaaacttggagctctcctaatgaagaattggatattgggctaaccaggcactaataagaggtctgccaagtagccctgaatggcctgaagtcagaaaacacaaatttagaatggtgacaatcagtgtgcatatacagttttttctagcaatgcccagtggccaggcaggagtaagaaagcacatattggaacaagtacatgtaatacatatccaagagggaattgaggggtctagtcagaggggtccaaattggataaggaaatgaattcaggagggagctggttcttaataagatcaaagactagacattatatcatgaaagagatggaaagagaggaaactatattcagggaaagctgtaatatttaggaagtgacatggcttaccatgatgacaagctcaaatgtgtgttgattttggattagacagcaagaattcaacacagagggcacttattacaaagcaactcttcaatatgactcttttacgtttgcatcttgaagaaaaaactttggaacattttgcacgtgagcgtgtattagtctgctttcacactgctgataaagacatacataaggccgggcgcggtggctcacacctgtaatcccagcactttaggaggccaaggcaggtggataatgaggtcaggagatcgagaccatcctggctaacatggtgaaaccctgtctctactaaaaatacaaaaaaaaaaaaattagcctggcatggtggcaggtgcctgtagtcccagctattcaggaggctgaggcaggagaatggtgtgaacccgggaggcggagctggcagtgagccgagatcgtgccactgcactccagcctgggcgactgagcaagactccatctcaaaaaaaaagacatacctgagactgggaagaaaaagaggtttaatggacttacagtgccacatggctggggaggcctcacagtcatggcagaaggcgaggaggagcaagtcatgtcttacatggatggcctcaggcaaagagagagagcttgtggagggaaactcccatttttaaaacagtcagatgttgtgagacttattcactatcataagaccagcacaggaaagacccacccccatgattcagttatctcctgttgggtccctcccacaacccatgggaataatgggagctacaagatgagatttgggtggggacacaaaacatattattccacccctggcccctcccaaatcccatgtcctcacatttcaaaaccaatcctgccttcccaacagtcccccaaagtcttatctcatttcagcattaactcaaaagtccacagtccaaagtctcatccgagacaaggcaagtcccttccatctatgagcctgtaaaatcaaaagcaagttagttacctcctagatacactggggggtacaggcattggataaatgcagccattccaaatgggagaaattggccaaaacaaaggagctacaggccccatgcaagtccaaaatccagcagggcagtaaaatcttaaagctccaaaatgatctcctttgactccatgtctcacatacaggtcacactgatacaagaggtgggtttccatggtcttgggcagctctgctcctgtggctttgcagggtacaacctctctcggctgctttcacaggctggcattgagtgtctgcagcttttccaggctcactgtgcaagctgtcagtggatctaccattctggggtctggaggatggtggccctcatctcacagctccactaggtggctccccagtagggactctgtgtgggggctctgaccccacatttcccttctgcaccgccctagcagaggttctccatgagaaccccgtccctgcagcaaacttctgcctgcatccaggcgtttccatacatctgaaatctaggcagaggttcccacacctcaattcttgacttctgtgcacccacaggctgaacaccacaggaagctgccaaggcttggggcttccaccctctgaagccatgcaccaagctgtaccttggccccttttagttatggctggagtggctgggacacagggcgccacacctgtagactgcacaacagcagagagaccctgggcccagcccacgaaaccactttttcctcctaaatctctgggcctgtgatggaagggactgctgcaaaggtctctgacataccctggagatattttccccattgtcttggtgattaacattcagttccttgttacttatgcaaatttctgcagccagcttgaatttctcctcagaaaatgggattttcttttctatcacttatcaggctgcaaattttccaaacttttatgctctgtttcccttttaaaactgaatgcctttaacagcacccaagtgacttcttgaatgctttgctgcttagaaattcttccaccagataccctaaatcatctctcaagttcaaagttccacaattctctagggcaggggcaaaatgcccaccagtctctttgctaaaacataataagagtcacctttgctccagttccccacaagttcctcatctccgtctgagaccacctcagcctggatttcattgtccatatcattattagcattttggtcaaagccattcaacaagtctctagggagtgtcaaacttccccacattttcctgtcttctgagccctccagactgtttcagcctctccctgttaaccagttccaaagtcacttacacattttcaggtatcttttcagccgtgccccactctgttggtaccagtttactgtattagttcattttcacactgctgataaagacatacccaagactgggcaatttacaaaagaaaaagctttaattggacttacagttccacatagctggggaagcttcacaatcatggtggaaggcaaggaggagcaagtcacatcttacttggatggggtcaggcaaagagagagagcttgtgcagggaaactcccatttttaaaactatcagatctcatgagtcttacaagaacagcatgggaaagacccacccccatgattcaattatctcccacggggtccctcccacaactcgtgggaattatgggtgctacaagatgagatttggatgggccaaaccatatcaatgtgtaaagtaagttatctaatggcaagagggaaacacccattgatagggaaaataaatcccatttatattaacagtatttatgtattacatttcagttgtttagtgaagtatattcaatgaccatataatgaattatgaagaagtgaaaactgaagctattttaacttgctatttccattctaaagcaaatctcaactcatttcagtcaggtttacatcattaactgatcagtctttgaataaaataattttaaatttgatatcaagggcattctgaatagaatgactgaattatatttatttgtccttttactttcactgctgtctcaggaagactcttcttatgttttctatagatgatacctctctgttaaagtcaaagacattttagtgatttatcttttttataaagatatgccacatagtctggatttgaaatgcagtctgcaaagccaggcatgcccataaatctgaatcttttattcttttctcatatagaaaaagaagatatttttacacatggataaaaatactaaagtagaattgcctttctcaaggtaaagccaaaacacctatagtgtgatgcagtttgtttaaattttataggtttgttgaacacattaatctattacaaataatagctaacatttctaatgagtacttactatgtgtcaggcactattctaaggtctttacgtaatataagtcatttaatccttacaacaaccctgtaagggaaatactattattatccttatcttctaagtgaggaaactgagtttaaatagcataatccaggactcccagctatttaataacagacctaagattcagacagacattgtgacagcagagtgaacactcttaattgcatattgcccctcagacttataattttaatacaggttaaaatttagcaaaatatttttcactatatatgtatataatacacacacacacatacatatatatatatattgacctacataaaaggaattaaaatttttaggttttattacagcagcaccattaatatggttaatcaagtaaagcaaaaatgttgttctgatctttcaatcacatttacaaaaatttaccttttattagtagaaattataattagtgtactttccaattttaaccagtgtccaaaaatcatgtactgtgatgtgtataaacagtgaaacgagtccaccacttgagtcaaaaccctttcttagtattttaagctttgacatgattccttttatagctaatttttaatattgggatttttttttaaaaaaaaagaaaaactggctgggcccagtggctcatacccagcacttcaggaggccaaggcaggaggattgcttgagcccaggagttcgagaccagcctgggcaacatggcaaagccccaagtctacaaatacaaaaattagccaggcatgatggtgtgcacctgtagtgccagctactcaggaggctgaggtaggaggatcacttgaggatgggaggttgagcctcctgtgagctgtgatcacaccactgcactccagcctgggcaacagaacaaaaccctgtctctaaataaataaataaataaataaaataattcccaagaattaagtctggatactggtttgaaaattatttcatatggtgactaatcagaagttatttcaatttttccttcgaagttctactttatacattttgtggaaacaatccaaatatttctgcctatttatttatctatcatttggtggagatataaagcagtagatttatgagtaaaattcagagataccactgattttaccaattcctactcacagatgccaagtctgatatattgtgtgtttctgtgtattctctcatgatgaaacattacttttaatcacctcttacaaatcggaagagtaaatgcatgtaacctgaaaagaactattaaagaatgcaacattaatgctttaatctatttccaccttctaatatctcatgcagtatgtagaataaaataaaaactcataattctcacatttcctgcatcttctttcaagatattgcatataaaactacttcgtaaagtagaaagtgaaatgcaaatgttagtaccataattattattaccgagctaacatgctaaattggtttgccttcaaaatgttaacaccaaattgaagagtaaaagtttttcagtgataattcttaggattccttgaaaaaagaatactaattagaatatatgatattttgcaaaaacagcaatacctccattaaattcctagctcctctttaagaaaaccagattcagaactagtgaataacttattacttttatcccatatgttctggcttttgattttacatcttagtaataagttgatatgggtatctgtaacccacccttcttagcaggttgccatgacaacctgaggtaaagtaccagttcactggagcttcaggctttgtccacgctaaatacaaaagctgcatttgatttcagcttggccgtttctgttgggagcaatgtaccacagttctttccacttccctggctgactttttcatcaccatggagaccagatctgcccacacaactaagatgtgaaaccattcctcatatggctaaaactaaggccttggttcccaaggccttttttaaagtatattactttgttaaagaagagttcctgcttctgcttttaaagtgtttattgattttccacaaagagaaaacaaactttctggtgctgaagatttaaaataaggagaaagaaaatgacattttccttggtcagtttctggttttgtgtgtactgtattcatggtgtgtactctgcatagtcaattactaaggaataatgtttcatttcaaattatatgacaatattcctaaatagtagttcacacatttaatgttcacttgatggtgggcttaaaatgtgacttttagtttgagatttcctaaatttgtcactaaatccaatattagtatcttttagattagttctgcacttccaataaaatcagtatgagaagttattctagaaccttgatcataagtatgcatggacttaaggaagaactaatgtaatttatcactacaaatccagttatagcatatccagatagatctgatgaattagctatagaagatcatatagcccaatttttaatatattcttgcatatgtaaatttgtaatgttagtatgtgtatataggtgttcatgtgtatacacacttatataatatacacacacacacacacacacacacacacacacacatacagattagtaccacaaatagggtcaaagttccacagagttctttgaagatcacatttgttatggagatactaaatactttacagctgctattatttttttgccatcccctcccggaaaatggcatcagtcaaaggagatggtaggaagtcttaagtggtgttgggaatcccaaattcaccccttgatttgcacattcctcaaagtgacttaggatggcatctcaactttcatggttgtgttttttaccctagagaaggcaacatggcccttgcttaataaaatacatatactaaataggaattccaaaaaattctgacttcaataaaacatagaattgttcttattttttaaaatatattatgaataagctagcaccataaaggtgccgtaaattagtttacagatgggaaacaaatttattaacataaatgaattttttgttttgtttactagcaagaagttagcaatccgttgctatatttgaatacaaattatgttgtaggatacagagaactttctgacatttcaaacatttgaattttgcaagaggaactcactgcaatgaagttcctgtatcattccagttttctgtaattacgctggagagtgtgaaattcaacatgtgatactaaatgttaaacacagatatagctgggaaccttttgcaatggctataaagtcatttgtatttttccataagaacattgagagtcagcatatctctaactctttagtggaactttctgtaaaagggcagtgccatataattttgtcagaagggaaaaatgaaaattaatatacaatagggcatttttaaaaaggatattcttcatatgttgttagattcaatagctttccatcccaaatccaagatgactttgctggtccaaaatttaacaaccagcaatttccaagacagctaagattgaatatgaaaactcattacttgatttttagttaagatgaacattaatgctaatttgtttacatctatgctatatttcttacaaacatgattttgtagtgatttttaccaaattaatgtttttcttcttgtcatgtacacaacatattttgaatgcctaaaaatataataatttgaatgttggaataggcagatgacttaacaatggggatttttgaggattgtttatgatgtaattattgtagattagaaaataaaagaatgtgaaaataccatggattaaggtgagagattagatttataacaaatttgacataaagaaaaaatcttaatgataaataactgtcaagatacaattttagattcttacaaatgtttcttgaattttcttcttacctttctttggcacttgccttgctggggaaggtatctttcattgtccttaaattcaactggcagtgcccctaaagcagctccttcttgccagagttgctaatgagcaaatgatcccaaatgtcagactggtgtgccaaggaggttattaataaggcattaacatttagaagttattgatggaggaaaatcaatattaccatctttataatattgcaagctcagttagaaagagtaagcagaagtttatttcaggcttctacaatcataaagaatgttacagtatgggaggaagtaatgtctttagatttttagcataagaatcaattcttattctgctgtcagtaccccgcattagtactggagctaatgctgaatgatattcttctaataaaaatagcagtaatcctcccaaaatcaagatggcagtactttgaggatagaatatgaatttaatatgagagtaagaataggatggactagacctgtaggacaaaagttcacaaagatctatgttatatatatatacatacatatattcatttattttagtgtgtgtatatatatacactaaattcatattctatcctcagagtactgccatcttgattttgggaggattactgttatttttattagaagaatatcattcagtattagctccagtatcatgtcattcctcacgattcaattaggtaataaaagaggtactgacttgcaaaagtaagtgaaatgttaaattcttttcaggaagaatacaacagatagttctgcttgtgtgtgggggagtgctgacagcagaataagaaaagaattgattcttatgctaaaaatctaaagacattatttcctcccatactgtaacattctttatgattgtagaagcctgaaataaacttctgcttactctttctgagcttgcaatattataaagatggtaatattgattttcctccttcaataacttctaaatgttaatgccttgttagtaacctccttggcacaccagtctgaaatttgatctaaaataaatgtgtgtgtgtgtgtgtgtgtgtgtgtgtgtatatatacacatatatatgtatatgtgtatatatatatacacctatatatatgtatatgtgtatatataaatatatgtatatgtgtatatatgtatatatgtatatgtgtatatatatgtatatataaatatatgtatatgtgtatatatgtatatatgtatatataaatgtgtgtgtgtatatgtatagatcaaattttcaagacttaggaagctgtgccattggttgcttcccaaagaagctgagcagtaaaagtataatttgcatagcattaaaatttactgaccacagatcaagttagctgatcagcatcatggcagaagtatgtaagggcaaagtcctttgtttacttggagtgggttctgatgaagtgaacatactaaatgtatctccataaccccaactccccaggcacacatacccttatctattatttcaccagaatatcaatttggaaaattcaagtcgagtgtgatggacaaattaaatagcgtgggtcatagatgtataatcagtgttctgaagacatttttaccacccagtcatataagtgaaccaagattcagataaggttggaactacttttcagagtacttatcaggtaggaaagagaatgtcctaatagggtttgaaggaccaaaaagaacctattaaaggaaataggcaagaaaactatgttgatagagttgatcccaatttgccttttcattttgacagactagatgtagtcacaaatgaagtgttgaatgactcacttgttcaccagactggcagttctcatcactgagttacttcacattgattatcatccaggctgaataaaatctaattacatccttttaatacaaacatacaaggtggtggtagaaaatccacataaatttaaaacctgcactgttcatctctaaagtatttgggagttaaaaaaaaaaagtctactattttctgtcgggggttcatgtctcagacttcacctatgttatctctgtaggtatttcaactggaactgagaagtttaaggagattattttaaattaagtcattattcatcataaaatggatttcagaagcaacccaatctgccaatagcttgctgtccacctacattgctgaaagaaaaccttacccaggaatggttatttttactaaacttgtctcattggagtttaatgtgattcttctattaataacctcaaaataacatctcctgaaatatttaaaaatatggatggattaggatggaggagtcaaatatcaagtcaaatacagtagataattcttaactataaaattttaagatagaagtgggaaggaggtatacaactatatcataatctttttgaggtgagagtgttgtctttgtatatttattcctaacctttgatatagtatatatatatatacacccataggcacccattaaacctttactgaacgatatatttctataaaaattaattatttccattttccattttaaaatctgaatggcgacatttgcaatgacagtatcatgtgtcaaaattccatagtacattttcctgaaatatctacagacacttcattgaaaataaactggttgtaaattaaaacaacatgttaagtacttctgtaactattaaatgtgaaagatgtcttcagttgtttcgtaaaaacttcactcaaagggtacttcagatctgccttaatttcagaaagttgtttttaatgcagattttagaaagtcagcatgtgtgatagactcctggataagtaattaagtcataaatggcactctaaggtcataatataacagtaggtggattaagatgaaatactactttcataaggaaatactccatgtcttgtgatttatacacacaggatggaattgtgatttgggaatttagaggaacactcaaattatctggaaacagtattttcttacctgttttgcctatggcttaggttcatcaaatattttattttacccggaattgtgaattaaagaactccataagtgctgtaagtataaacacaaactatattatctatcactagttaccactttatttagaaaaataatattttatcatgaaaattttgcttcacattcataaaaatattttccaactccttctccctatggtattaaaaaataaaaaaaatctttaatatccagtctttttgaagtcaaccttttatgagaaaataggccctcaaaatttggacagataatactcaaaccacaattaacaagtctctgttttggtctgaacattctgaaccaaggtatgagcccactgtctccaatacttacatagagaaaagtaattatcactatcatttcatggtgttggatatccttgtttttgaaaaagaaaaacttaaatctaagcacatacatttagaagaaggggaggctccaaataactatgttaagtaaataaggtttttcaaaataaacacaaaacaattctactctcccaggagtagaattgtgttactcttgatagacttgaatatctgctattgatgacctttgttatccacaaatagcttaagacaagtagtccttggctttgcccttaaatttgccctcaagcatgctgattatggaactgagtgaaatagaattgagttctgtcttagaactcaaacagaattaggaatctttgtaagtgctcaactggcttaaatacttacttccattttaaaatattttcttctctttcattcattaaagaaaatatttattttcaactgttttatatttagccttaatcattttcttgaagatgttcgtacctctacccttatcccctctataatctaatcctcctcaggcatttgattgaagtatcatcagctatttttagcaggtcactaatggaagcctgattatatttctaaaacttatgtttccagaatttctatttcttcttattatttgggcggtcaagttttatttggggcaatgtttaaattcataaagcaaaaagagaaagaaacatcctcctcaagatttcctatgcaaattcaatctgtgtctcaaggaacttgcatggatatggaatctcactggaataagtcattctacacatgattcaacatggcattccatctgggttcatcattcagatctccaggagtatagtaacagggaaacaagatctgtttcttcttaacctaagctggtggcctcacaattagaagtttcagtgatgagtagtagcttaataaatatttattaaataatacgccaaacagaagcattactgattttctttgtggtatcatagatatgttgctctcatttcaaaatgtaattggctaaaagcttggtaaatagtgaaatttattttaacagcagcagtagggaatatttttatagttagagtaacagccaaaagaaaacaaaataatcaagagttatataatttatgttttttctgccttctattgttttttccatagagatggggtctcactatgttgcccaggctcgtctcaaactgctggcctcaagtgatcctcctgtctcggcctcccaaagtgctgggattacaggcatgagccactgtgcccagcatgcctttttctaaagaacatgcaatttccatttgttcttttagaaaagaggaataaaattagtctgtataataattttaactggtttgactattttgactttgtatcaggataaatgaagttgtccactacaaaggagaagggtagtaattgagaattgaacacaaagaaagagaaagcccagtgaaaacctaaagggagagaaaaggaaagagtgttgagaatcagaatgggacttgtaaaaagttaaagacacataaacatgagattcacagaagtccaagatagaaggacagtatcttgaagtaggtttttgtgttttagagatttcatctagattatacgggcagccctttgtgcacttgcttctgacccacctggctcgccagtacacgtatacttaagattcgtaatgcacatgccaagacatatagtggagttgagtgtaggagtgccgttgtagtttcttgtttgcctcaaatataaataggcactatttaacactacataaaaagtatagttctaaaaaatttatttaaaatttaccaaggcctctttcattttgccataatctcagtagaccaagatatttccatcagattcctcagcaaaaatcctgaaattgtttaagctgtgtgatacaatgtcagactggtgatgggattaaaaataaaatgctatgtgaagtccccaaactcagggcttctgacttagaaactacttgtatatgcagtgcaaaaattgctgttactccaaccagccctagccagtgtgattgacctaaagcaagaggtctcaaactgcagtgggcacaagaatcacctggattgcttgtttaaaatgcagattcctgagttccatacccagaaattctgattcaatagatgaggtgtagggcccagaaatctgtgtttaacaagcacctccacccccatcctgagattcagtagtcactagtactgtgagcactagtagttgaagagataccgtgccctagggagttatcttctcttatgctaactaactggtagctagttgtagccattttgaaatagtacttctccctccaccatcccttaggagctaaactgaggagatgtttccagtctcttgcaatagaattcggcaattgtgactcgattaccagggctctagttcagtttagtgtgggttaagtgggcattaaggaatgtgtattagaaattaaaaggttcatgtaaccttatctctgtggggaaacaaaggatgtgtttaggataactacaaaatgtttgaattgcttagataaattaagaacagtttaaacttagaaatgaccttgtgcccaaggttggattccctctgattttgctgtgtgaaattccatgaccttgtgaaacaaagtggtagaagctaaagctagcattccagtattataatattctaaaaactgaggtattgtgttttgtttcgtttgacctgtatatgaagattattcagtttccacccccatttctgcaaaaagagtataatattacagacaaaaattagttccgctgatttctgaactatgctatatcttgtttgctagatatcagtgttataggcaagatgtgtccctccccattttctaagggaggacataatgaacaacatgctttctctattctctctcccaacttgttccttcttttctcaatatgactcaaaagatactacaagatgttgcagataaaaatctgcactaggctagagatttaaaatattgctgatttgttcctgctgacaatatttattagattcctcaagatccaaaataaaatgacctaaaagagggtacagtttgttttatccaaattgttattagtttctcaggtcattcagaaacatccatctcttccagtttcttaactccttggcatgtggcttatgctcaggtgtaaagtcaccctttcatcacattcactctgtcttagcttttcgtttcttggcattttgtgttgttaagcatgcggcctcctcattggagcaatactagctaggctgttccactgtctcactgattaggacatggtagcatatatatcaggtcaatcaaatacccttctggtcagaagactagagaggttttcttcatgcttcttgattagatgaatttgaggaaagatctcgtatagaaataattttaattttctcaaaagaaatggtaattttacatgtatatggagaatattttaacataaactattctgattaaaattatagatgtacatatacaagtatagtggtgggaaaatatttttctgcactgtgtgttattgtgtatatttgggagattaacatttccaaacaaccaaagtttaaagcaaaaggtgtcccatttatggccaagtagacttgcatgccaacagaaagacattgtattaaaaccatatgcaattctagccatatttttctactttctcttcatgggtattgcatgatggtatttctaatacaaatactaatatgctttggaaataatggcactcgcaggtctttcatcatattgtatcactgctttatcatattaggctaatacactgcgagagttggtagaacctctccatgccaaatcggatccacttctgttggcactcaacccattggactcacagattgataagctaatgtttagagaatttagatcggagagagtcggtacggcgcagactcaacatcaacctcttgcaagcaactaaaatggcctcgtccttgctgtttataacagaaaacagacttgtaaaaagcttagatcatcaagtgttttggattgggggcctcccaaagggatataagaggggcaggccactcttaagaagaatgcgagctttctacattgggactagcataagatcaaagccaatcaagatggagcacagtaacagaaaactgcggtttctgtgggagaacagaaggggaaagggtcttaactgggaaagggctctgtgtggtaacacctcagttgtgttctcctgacaccaggaaaagagagggatcagcttcaataactagaaaattctggctgtttaatggactctttggtggcctctttaaggcaaagcagagaaagcaaattatgtattaagtgtattttgcatttttaaaacttgacgtgctgtattgtactaaattaagtgtaatctattaaggcaaggtatacacaatttgctttgaaacttactatgtttattctattataaagtgtattcaggtgcaacacagagactgctttcggtgacattaatgaagaaaatttctcatgccaggctttattatagaatcttcagctaaaatcctaactttctccttatttcttggcacttgtatacaagtggtgttgcctcttagggcaggcatgagctattcttttctgtaaaatattttgaatctataggctgtgggtttcatttttgaaaagtattttgtctggatgtctttcaaactagcttcagatattatttaatactatgtaactgggtcccctatggctcaatcaatattgcttatttttcttctgtagtggatgtgaaatttcctttagttggataagatacactgtaataattttaatgctaattaatgatatttcatactgtgcaatgaacagataatttaacactgtattttgaaatgtttttttcttcctgtcaccgcagtgtgtggtattgcataatgtgaatacctgtaaaaatataaattacttaaaaataaaaatatgaccaattggtatcagatcttttcagatagctaaataatttgctaagtatgcctgatagtaaatatctttctaaaaagaagtaatcagtgcttctttctcacaaatggaatttgtgtctgtgaataaaatcacattgatctgcc

SEQ ID NO: 5529 - DNA, 268444 bp, human; identical to SEQ ID NO: 5528

SEQ ID NO: 5530 - DNA, 280276 bp, human
tcatttccgccgggcagctagtcgtgctcggggcttcactcccgcgcgtgaggcgagcgggcaagttggctgagggcgtgcggcagaggctgcttccctcggcgacgcgacccctcagcaactcaagctatgaactgaagctccctagggacggagaccggagcggagcggcggaggcagcagcagcagcagcagcagcagcagcagcagcagccgccgccgccgccgccttagcgggaactgagcagacccggcgcggagccacgactcctgcacgtttacctccctgtcgccgttcctgccggcggttggctaaaagacgttacagccgcgagacccgacacacaaaagccgctttctccgcgccgcccgcccagggaggctgcggccagcaagggaccccacctgagagcagctcgggctgctgagttcgttttgtgtctgagctctgcgctctgcacggaaccgaccccgtacccatggctctgataatggaaccggtgagcaaatggtctccgagtcaagtagtggactggatgaaaggtaatgcccgctgcggggagggtgaggcggcactggggcgcggggcaccagtgcgaggttaggagggggcgcccgccgcgccagagcccgccaccgcggcttccactggcggatcgtcgtacgcgtcggggcgggggtcctccaggactggcaggggcctggggtccccggtctccttttgtctccagctagaggggcgcggagcggccagagagctagagggcagcgggcgccaccccgttggaggcaggaagtcgggaggcagaataccggcgcatcttgcgtactcccctctccccttactgcccccgggccaggaggacgtggcgacccttatctcccagctcagggtggactcccccaggacctgctcccctggtcgccctttcctggcccctttgttcctgggaaagctgacgccccctcggcggccgcccttgccaggtgccttccccagcgccaactctcccaagcaacttttagcccacataatggggtcaggacgcggccgcccccattcggagcctggcatccccccacacccagatttggctgaggatgcccagggtgggggtatgtgctactttgagggtgaggacatcatgcttcccctgggacagcatccttgctgctgtctctgggctgcctccagcgcatcccctcgcatcctttgccttctctgctttctccctttcaagccagtcgaggttttggacctcacggctttttattaagggctcaacgccagatgtaaggtgatgcgcattcaggtaccttcacatttcttccatcttgaaggttcccccttttgtccctggcgatttataataaccacagttatagacactcaccctcctaatcgcaaacgtgagctttttttctgatccctgggctttcctgtctcactacctccctctgttgtctgagttaaggggcttgtagaggactcccccacccaccaaccccttggatcctcaggcccaactcttccctaagattttgggaattgaagaggggatggatgggatggaatggaataaaggatgcgtggccacacttgggaaatgttagcgctttgctcgaggtcatacctgagcaaactctaggtagatcagtcagggaccaaaggcttattatcgctgaaaatgcccgttcctacgatgaaggagccccttcttgggcttacttaacagtcagactttctaagctccagataatttagaacgaaaggtgaggtgattgggagggattgagagtgacagggagaaactgattttttttgctcattcttttccccagcctttttggccgcttgcttattcttgtggatttttctttattttgctttccttttattcccttacttgcccctttattcctcatttactttgcttttcttttctaatatgtggaaactgctttgtaactgctaagcagtacaaatgtgagtgaattgaattaaacctaatacattatttatcgactgcacccctgtgtgcagtgcattgtgctaaggtgccatgggggatataaagatgactaagacaaagtcctgcagtggctcatctttgctgctgctttttctctttatgtatttgctattgaaattccaatatcttagattcccaccaattatcctcactctccaccttctccgtttctcagtgatggaagaaagagccagagtatatacaggaagcaacaatgcttaaaaccccgttctttgaatttgtctaaaaggttactttagtttgagtctgttgctgaaatattaaaagacaagctatcttggctccatgggagtctgattaccttcatagactacctttcgcaaattcccatgatgcctgtagtgagtgctgcatactcagtctccacctcccaccctcccagttatattcttgcagtttcccctctctccatagtttaggtccactgaagcaagtagaatatatgatgcacctattctgacacacattattagttgtccagtacaccagtcctttaaaaatctttccagcctaaaatgtggcttctttgaagttaggttaacattgttagctgtgatttgaaaattttttttaaatgtaagtcgaataccttgttttcatacctgttggtgacgcattttagagctatttgaaaagatcaattgggtagccaagatagtttgtgtatcgtgtatacatatgactggaagagaatgaatgatataattacctgtatatttcaaatcccagactacttactgctgaaatttccttaatattcatatatatttgatttgagatattatcagaaaatgagattttaaaaaatagttggatgaaacaaacatttcctcaacttgtaacttacactgttaccttaatttttctctctttgcccttttccccaaataaagttaaacaaaggacattttaaaaatatttttcatcctgcagtaatatttaaaagtcaactgctaatttaggctatagctttgagatggctaaacctcatttagtgttgtataatatgtagtgttgtaaaggcagtaccaaagaatgaacaagactgttgaacaactgcaatgtgggagttcttcagaggatgctcctaatgagacagtttcatcatccttagcattaaaagcatatagtatatgctttcagctggtcacaatcataaatagttgtaactctgtttagtaaggtacattctttatgtactttctagggtatttttttcttcactaaacagaaaaagaatcgctaagtgtgtaagaataggaatggccatatatttatgattctagacaatttgtagaagtggtatagaaactcagtcccagagagggaaatgaagggggaaaaaaagctgacaagattattaagctttagtggcatatattcaagattatttatgagggacaatttttacattgcaattttgatgcaatgtataaatggattcattttgattgatcaatttttattaaaatatttgagggagatggaaatataaaatgtatatattgttagtagtaaaaatataaggaaatccttgtattcttttgctcaccaacttcattatttgtaaaatcaaatactcaactaaattttctactgacagtaaaaattggatatgacacagtgtcaatgttatttccagtaagtacatgaactccttatgagtcagtgaaataagtagctatatcccaaattatcctgatagtacttctggctatttggagatatcttatagaccttcaaattaatttttaatattaatcttataaaaatatttttggagaaaatcaaatactcataatttagcatttgaaactgaccttcttcaattggaaattgcatccaatcctcttgtagtttttatattttaaaacataaactattttcaaggtaaatagaggcaaataagttattggaaaaagccataggcagaaaagtaggccaataattgttctaatttttcctccatctgttattctaaaataagttatttctcagctcctacctgttcacttgcagggcctggaaatatttcataatttgcagttatttgagtccccagaccatctctacttttttgcccactgaaatataacaaaaacccctgaatgctttagggcccctgttattaactttattattaattttcctagtccgtgtcacacccagtctttccatttttttttcttacatcttttccaactctgagactcattcaaaatatccacatgactaagttatttttctaggactcagctccctacattacattcttccagtaatctttaatctctctgggtcaaataaaatgattatgacttttcagagttaaccaataggccccattttgcttgtcttctcttaccatctctgtgatttagctccagccacttttgtattattatgattcttaaaataatctaaatttttaagatagccttttctcaacccattccacaatcaactgctctactctttcctgtttactataaatcatttcttcaagaggcattctctgacttctaatttctgtcctgatgactcagccatcttgaggatagaaaataaaatacattcttttaggtataaaaagcaaaaccaatgttttgtatacagtcctgtaatagaggaaaatgtagtgattatataaagtctagtcagtataaaagttaaatgctgtaaaggagaatgtgttggataaggcaaagatgttttgacaggtacaatactctttagtaattcttttttcccgtcataggacccagagctgaggttgaaatttgtctttgttacataaaggaaaatatcaaaattttgagttaaactgtcttgagagagagattggaaataattttctggcaggaactgcaaataagcttaagtgatcaaattgtatcacttccttttgaaaacttagggttttttttcaattgaaaggtgactaaattggcaccaacaattgtctactttggatttgacttttttggggaacaggaattcttgtcattttatgtaaagaagaaatatatcttttccatatgtagaatttcgttcagaagaaatgttatttttcttatagtgttattaacatttgctccttaatgtaacactcatgatttagtgcagattaggaacaaggagtatatttatgtagatatatttgctccatagatattattttctcagtgcttttgcatggagggtgctttaatgggttgttttaaattaattattctctgctttggggaaattagcctctgtaagggatggtagtgacattgacaaacttaggcaaagacagagagaggtgccaactagcacatgtagtaattttttaaaggctgtatatgagcaccattggaaagagaagatgataattttattgaatcaggaagggatctgtgaggagggtggggttctagcaactatttaagctacttatttaattaaggcataatctaagagggatgtatactaaatgtagcggcacagcaagaaactctagagttgaaatggggttattaactaaaggggggttgtatataggtttgtctggatgaaggagagaggtgggcagtagagggaaagtgagggaggagcatgagtaggtggcacaaaagtacaagaacaaatctgcatttcacaaagacaataaaactctcatcatgtcctgagtttaaataaatgccacattataaaactttagctgccaaaaataagcccacaaagaatgtgtattgaattggtacagctgtttcaaatctgtttttcaggaatgatttgaaaataatgttaaattattttgaagacaaatcattaacatgttgttagatatttcgaattttactgaaccaagttcttatatgaagaatggaaatagacttttaagtattaatactgttcttaaagcaatgataaattatcatttttatttataacagagcaaccctagattagggctcaatttgttctttttttttttttttttttttgagatagagtcttgctctttcacccaggctggagtgcagtggcacaatctcagctcactgcaacctccgcctcctgggttcaagtgattctcatgcctcaacctctcaagtagctgggattacaggcacccaccaccacccctggctaatttttgtattttttagtagacacgggatttcaccatgttggccaagctggtcttgaactcctgacctcaagtgatccacctgcctcggcctcctaaagtgttgggattacaggcgtgagccactgcacccagcctcaatttgttcttaatgacttttagctttctatgtgtcttccctgcagtacctcacacataagggttattgtgaagaataaagttattagcttctaaaaagagtactaaaagagtggatcatctgtactaattttaaaaaaggttgggggaagggagtataaagtaatttgaaaaaaattgagtctaaaagttttaattgttcatggctttttattgtttagtgtctgattaaaaacagcaagtatagtcttcaatgtggaatcattgtgttgaattacattcggtgagggaattcacagttttcatgtatagcataggcctgtattcctcaaaatggtatatttttgtggttgtggaagccaaatgatcaaaagaagccaaagagttgtgttttttttgttttttgctaagctttttaaaacattatattaaaacaaacatggatattatattcatgatgtagaaagcaaaattggcattatttcaaagatgagaccagagacttaacaggaattttaggcttgcaacaggctgtttaaagctgtattctccagacctcccagggctgagtacactcttttgagcaattacagatgcatcagtggaaaagttggagaagtggtggttgagtttaaaaaaggtaaaattaatgtactctgtttccctttttttcctattaccacaaggcacaaaatatgaccattttcagtcgaggtcatgataattgtagcatcttaattttgtttatttgtttgatccatacacctgcagtcaggatgaattccttgaaaataaatctcatccgatctcattctctcacttcttaccctcatcagtttaaaacaatttaatgacttctcattgtttttaggataaaggtcaaagtccttaacatggcctataagactcttgaaggtttggccattgcctatgaggtaagcgtcatgcccagcaccaagtatgcaggctgcctcaccgtccttcctgtttgcctaccactggacatttgcacttaatatgttccctatccctcttcacctagttaagtcttactcacccttcacgtcttaggctttttctcatccaccttaggaaagcctttccagatttgttaaatcacatcaaatcctcagttatatgctgtcctagtaccatgtatatctcctgtgtcccattcaccagttttatttttatattaatttggatggttatttgatatccaactcccccactagatgagtgcagggaccccatctatttcttgtaccagtgtgtaaaaaagtatctggtatgaaataggcacttagaaaatatttgttgagagaaggaataaattaatttattcacagattactggtctgtcagcaaatctgctttcctaaatgacaatgcacgtaaagtcccttataatgctctaatggatacttcagtgccaacttgtatattgtgtgccagaatacagtagaagtagggttgctttatccatttctcatagttgtagtgctctagccaattcaaagatacgaatcatggtttaaacttattttgttacaaaatattaataatttcaggaaattaataacactttggtgtttatgccatattataaatagtataaatattacttactaatatcacttagtaagacaacatgataagcaaatacttattaaaacattaaaacacactccttctcctaagcatttatttcccttcattcaaattttctaattgtttcttcatttgggtattttttaaagaactctatatatcttagaatgcatgatggagtgaaattgatcagatgtcttaattttgtcctcataaaaataaaaacaaaaagctcatataaaaaattaaaatgcattattctgttgtgaggatatcctttatttgttaattgggacgataaaatggaaaaacaacccttgggcttaatgaaaccattatcttatttattatatttagtgttcaatttgcatttttattaataggaatacaattaaggtatttaaaggtgcatcttaaatcagcattttcttgtgtaatttttcaccgttccctctgattttgaaaaaaagaaaactttaaaaactagatgtaagtttatcattactaatttttgaagggcacttgttaagaacatacgtacagaattattgcaaagcatagtttgctaaatacaggtgcctcaagtggattttctatgaattacatgctgctagataatcactagtaggcaacttaccaaaatttttctaataaagcctgcctcctcccaatttagaatcattaaaatacaaatcagagtaagtgaaattgtaaagatcttaataggcatgccagtttgttaactctttataaaacaccatcaggcttaaatgctctagctagtactgcaaaacaatggattgcaattgtgccctgatttgacttgcaaacaactattctacaagatggaatttttaaattttaaagatgtatttaatttattgtttgattttaatttaaatcacaatcattaattctaatggaagttttcattatcttactcttgcaatttcaggaaaaaagagtttgttgctatttgcataaatgcattgaactttaaattttactaaagtgcagtaataactgttttagctctctttgttcatctgttgactattttaccacaacataaaattgtttgaaaaatcaaaatttatttagtaaaccaaaacttgcactgacaccaatatatgatagtttgtcatgataaaaatattgttacataactaatatcaagtatagcatacatgactcttatgtgtttacttggcattaatgttcttagaaattaagtaggttggatggtctttagatacagtggtagataagaagaaacctcattaaattagttgcgtttttaaatgttgctcaatatctttttttttttttggtgtttgtttgaactttttattttgttccagatacatctgctatttttaaaacaggcttgcaacatgttttcttaagtaatagctagaacaaatcgatggaagcctggcttagatcctagattttccttttttcaacttatttaccaaagattgtaaaagaatctattttctagtaacttgttagttatacttagcaatgtaatttattagtaaaaacctttaacaatgctggcattaaataatacagctgaatgattaatgttaacactggctgaatttttgttttaattttggtgtgttttttatgtgtatataggaacttattttgtatattttttcagaaaattgatattttaattttgtgaaaatcatttatattttggttttcaaaacaggccattgggatattaaatacatataacagagaaagtgtagagattttgctcatgatgctcaaaacagacatatagtagtccagtggctagttttcctcctggcctgctggaacttacgtagaaaccaagtttgatgtggtatagagctagcatgatatggcagggctaggtgctctttccccatttcctattatattggtgtcaggatgagctttgtggcagtctctgttggcactaatgttacattaaatcaaaggaacaaggcttccttatccagaagcctgctctgttgccttctagctgtcagaccagagactttcagtttgatgttgaattgacacacacagagtagttagttctgtgaaatatttgggttagatgatttttctttccagtggccctagacataatgctttgagtttatttatggtaaaaacctgttaattgagattctgtttatttgggatttgtgataatttcactgtgctcctattgaagattactgttaatatgtgaaggaaaggtttgctgatcaatctaataatgcaaacaagattggaaagaaattgtttgacctgggagaatacaatgtttttgtactatactttgccaggagccacttacatactgaaaatatgctagttagaaaggagctgtatttttacttagaatttctgtatacttagaattatcagtctttattttttggagtattttccaaacattatttaatatagcttggttcttctcattcacccaaattggaaaggtcatgtacttcacattatattattgctagtaatctttaaaagtgagataagggagagttattaacacctttttataggtaaagtacagagaagttaagcagctcaacagagattgtacagctgttcagtgaaattaggtttgacgtcaacttttctcctactggattggatttacaatttagtgggcaaaggacacaattcagataggtacacaatggttttcagaattgaccttttaaaatttttttctgaattttctaccctttaaaaattggcataatatgtaatatagtacaggtaagagcactttggaatcatgatacctgggtttgtatcctgactttatcacttcttagcttgtgtgatcttagggagagtttaagtaattttcccaagttttctcctttttataaaatggggatgctggtattacctacaattaccaatctaaaagatgtttctacattttgccacatttttctgttgtggtatacttaaaacaatgccttgtatatagtaagcacatataaatgtcaacttttttaaaggaagagattatattctgttggcaatattcagaggcagaactaataatagattatatttattaagtgcttactacatactgtgtcctgtgctaggtgctttccctacattacatttaatgcctgtcttagccctgaaaggttggacttaatccctattttacagatgaaggaactttggcttagagagatttttacttagaaatgttgaatgacttgtcctatatacctgtatatttattaagcaggtgtttgttttaagtattgatttctgattggttccaaaatacctaatatttccaccttgcttttctagcagaggtagatgtgacgtgagaggaatcctggaaatacttttcaaagatgtgtatgtcctctccatcagacctaccttctctagtatctggtaaggtgggctatagtttttgtgtcctttgggcttctagtgagatgtgcgtgtgcgcgtgtgtatgcacgatgagttgtttctacttctcaggatagggctttcattagtgacaaagatgccacatattactgtagtcttggtgacagcttttgtattttgaagtgacccctagagtttgatgttcccctctgctgagtctggatgtaggcaaaaaaaaaaaaaaaaaaaaaaaagcctaccctgagcactactgccaagaacccagtgctgagatgttttgttatcaaaggattgttaatatgtggtgcctgataatagacattcataagtatatcacattttaccaaaaataatgatgttttgttaagatttactcagcagtggttagccttgctacctgcatttcattagtgtttctttgaacagcagacattttttggtgcgttcctatggatccgaaacccttatatacctacaaaatgttaattcatctcctcaaattgttttgtttggagacatttatcatagaccaaattgtgatatgataggaaagtttagtgaatcacgaaagcaattttaatgctagaggaaatttaatcataattagttaaaaaactattgtgaaataaatgcaaaatatggagtggtcaagttgaattagagatatttgaccaatggagtgcttgtaaaatggtaatgaaaggcacaattccatctacattatatttgaaagtgatacacataattttgtatatgttttaaaaatatgtattctagtatatatgtggaaacttaagtaggatttgttcaaagttatgcaaacatgatattttctgtttctccttgctttcttttaatagaaagagttaaggtgagtttgcttcagactggaagtgttaaaataagtgaaaataacttaaattgttctttacttgtggagagaatggtttgaagtttctcactttttataaaagctattacaatacccaggacaatagaaccttaaaaaaaattgtgaactgtggtagattaccaaccactttgaagttaccttagtcttgtctctctgactctgtaaagcacctttttctcctaaattgctcattatcctttaaaattcatatgaattaaaattaattttgtttggggatgtttttgagaatttcatcactttctttgaaataattgttgacaccttgttttaaaaaacaatctggtttaaatatggtaatactgtgaatctccatctacattaattttaagatgtatctgatttaatgtttaaaggcagtggtttcttatgtttcagattttcaaatgaagctgcttattcttaaacatatgcatactggaaactaatgcatgcacatagaaaataaatacagcagcgggctggatgtggtgtctcatgcctgtaattctagcactttgagaggttgaggtgggcaaatcacttgagctcaggaggtcgagatcagcctgggcaacatgacgaaactctgtctctacagaaaatacaaaaattagccaggcatggtggggcacgcctttagtcccagctactcaggtggcagaggtgggaggatcaccagaaccaggaaggtcgaggctgcagtgggctgtggtcgcgccactgtactccagcctgggtgatagagtgagaccttgtctccaaaaagaaaaagaaaagaaaagaaatacagcagaatagctgaggaactataacactattatcacgccaccgtccattcattccttaatatcaatatctgtatgtacaaatttctagtttcataaatgtcaaacacttttttttcttcaatcagaacccaaatcaggtgcacacattgtagtctagctcattcttttttcctatgtcaatctttttggatgttttacataacagatgttatgtaatatctcctgaaataaaattcagataatataacctacctagtcacataatttttttaaaactcactaaaatgcccttattgtaataaaaagaaaaacacataataaaataatatgggtttctatatgtacatactcagtatgactatacaagaagaaaataattgatatttttcctacttttttttttgtttgagatggagtctcgctctgtcgcccaggctgaagtgcagtggtgtgatctcggctcactgcaagctccgcctcccgggttcacgccattcttctgcctcagcctctcgagtagctgggactacaggcgcccgccatcacgcccggctaattttttgtatttttagtgtacacaaggtttcactgtgttagccaggatggtctcgatctcctgacctcgtgatccgcccacctcagcctcccaaagtgctgggattacaggtatgagccaccgcgccaggcctatttttccctacttttaatgaacatatctggatttaaaagaagtgttaaaatcagaagttgttccatagagtgtacaagagaaaatggaagaacagatgaactaatagacagtgaagtaaaaacaaatattaggagaaatgttaatggaccagactcatttgatgagccattctagtaattcctattgaacatttgaaagtcatgagtgaaggaaacagctttttggagaatgttatattctagggctgggatagggaatatgcgagaagagcctggagcatcctgtagtgccataaagtaaggaagtgttcaaaaaacacaatgatgagggcatgtaaaagactgaaaagccaatctgaaagagcttccaatagctaaagctggaacaatttgaacaataaagtattacagtattggattataacccaacatataaaataaatatattcatggatccatcctgatagatagaaatgtctagataagtagagaaatggaggagaagagacaaatcatccatgtagagaattacaaatcatttatatacatactccctaactcccaccacaaagaggtggcacttaaatccccactccttgattgtaggttgcatttagtgacttgtttccagagagtagagtatgaaaaaggggaaacatacaactttatagtggagaaacctggcagttgctaccttggccaagtgatcaaggttaacatcatcagtgataagtcatgttgatagcatgtacccatgatacgatgtgatatgatgtgatgtgatatgattgatatgatatgatgagaatggttctttatctctgtggtctttctttactccccacaaacccataaccccattctaaccatgagaaaaacgtaagaaaagcccacatttaaggacatttttcagaataccgaaccaatactccacaaaactgtcaaggtcaccaataacaaggaaaatgtgagaaacttaaaaaccagaaaaggctaaggagacatgataattagttatattatggcattctagataggatcttggaatggaaaagtacgttaggaaaaataatgaaatccaaataaagtgtggagtttagtttattattagcaatataacaaggttggttccttaatgtagtgaatgtacatagtaatgtgagatattaataataggagaatatgggtgaagagtatacaggaactctttatactattttttgcaacttttctgtagatgtaaaactattctgaaatttttaaaaagttgttcaaataaaaaagttacagtatttttcaaatttggtaataccaaaagataagctatgtctcatatatgaatagttttgttttgcctctctggaagtattaataatgaagtctttcaaataaaaaagggcacttgggatatagagttgttcttcactatgtgggattgttccatccatggatctagcaatcattcagtaacctaatcattgtgataacccagtactactcataattctcaaaatgctcccaggaaacaatattggccctggcctggcatcaggatccctggccttaccacttttcttttttgtaaaccttatagttttccacgtgtgaacattttttaaattttatgaatacatattgttgtgatttgaaaaataattttattgaatgaatgttatactttgttttcattctactaaatttaatcttttatttgattagcattttttaccttttgctaatcaggaaatatgtttaagaaaaggagattaaatgtacatggataggatggagaccaccaaaagttagctccatcttctcattttaccttaatgctaaacaatttgcaattaaactctcagacagaagagtgtgctattctaaacattgttaacaaagcttgactcccagtgttccttctaattgtagtttctgtttcctgtaggcaatttgtgtgggaatgttaagcaaggcatgataatttttaagtaaataaatcttgtggtttataattgataatcagctgtatatataaatgtgtgtataaatatgcacacacatttacttagggcagatatttagttacctagggcagtatattagtctgttcttgcattactggcataaagacctacccgagactgggtaatttataatgaaaagaggtttaattggctcacagttccacaggctgtacaggaaacatggctggggaaacctcagaaaactttcaatcatggcggaaggtgaaggggaagcaggcacgtcttacatggctagagaaggaggaagagagcaaagggaaaggtgccacacactttgaaacaaccaggtctcatgagcactcactcactatcacgagaacagcaagggggaaatccacccccatgagccaatcacctcccaccagggccctcctccaacattggggattacaattcgacctgagttttgggtggggccacaaatccaaaccatatcattctgccccggcctctcccaaatctcatgtccttctcacattgcaaaatacaatcatcccttctcaacagcctgccaagtcttaacttatttcagcattaacttaaaagtctacagtccaaagtctcatctgagacaaggcaagtttcttccatctatgacactgtaaaatcaaaaccaagttaggtacctccaagatacaatggggttacaggcattgggtaaatacacccattccaaaagggagaaatcagccaaaagaaaggggctacaggaccatgcaattctgaaacccagcagggcggtcattaaatcttatagctccgtaattacctcccttgactccatgtctcacatccaggccacactgatgcaaggggtgggttcccaaggccatgggcagctctggccctgtgtctttgaagggtacaacccccttggtggctatcccaggctggcactgagtgcctacgtcttttccaggtacatggtgcaagctgttggtagatctgccattccgcagtctggaagatggtggtcctcttctcacagctccactaggcagtgccccagtggggactctgtgtgtgggccccacatttcccccccacattgccctagtagaggtcatccatgaggtctcctcccctgcagtagacttgtgcctggacatccatacatttccatagatcctctgaaatctaggcagaggctcccaagcctcaactcttaccctctatgcacccgcaggcttaacaacatgtggaagctgccaaggtttacagcttgtaccctctggatcagcagcctaaggtgtatctggggtccttttagccgcagctggagctggagtggctggggacacagaaagcagtgtcctgaggttgtacagggcagccaggctctgggcccagcctacaaaaaccattcttcccttctaggcctctgggcctctgacacgaggggctgctatgaaagtttctgaaatgcctttgaggccttttcctcattgtcttggctattaactttcagctcctctttacttatgcagatgtctacagctatcttgaattccttcccagaaaatgggtttttcttttgtaccagatagtcagactgcagatttctgaacttttatgctctgcttcccttttaaatataagttccagtttcataccatctctttggtcatgcatatgaccatacgctattagaagctaccaggccacttcttgaatgctttgctgcttagaaatttcttctgccagataccctaaatcatcactctgaagttcaaagttccacagatcccttgagcaggggcataatgctgccagtctccttggtaaagcattgcaagagtgacctttactgcagttcccaataatttcctcatttccatatgaggttacctcagcctggacttgactgtccatatcactatcagcattttggttacaatcattcaacaagtctctaagaagtccaaactttccctcatcttcctgtcttcttctgagccctccagactgttccaacctctgcccattaccaagttccaaaactgcatccacatttttaggtatctttatggcaatgccccactcctacataccaattttttgtgttagtccgttctcacgttgctagtaaagaactacctgagactgggtaatatataaggaaaagaggtttaattggctcacagttccacaggctgtacaggaagcattgctggggaggcctcgcgaaactttcaatcatggcagaaggcaaaggagaagcaggcatgccttacgtggttggagaaggaggaagagagcaaaggggaagatgccacatacttttaaacattcaggtcttgtgagtattcactcactatcacaagaacagcaagggggaaatctgcctccatgatgcagtcacctcccaccaggcccctcctccaacactggggattacagttcaacatgagatttgggtggggacagaaatccaaaccataccaagcagttttgctgaaatcgaatataactcaaagaccttttctgattgtttttaatcaaggaagtcaatgcttttcttcttgtcattaaatgtggtaccttattttcatcttataatgagtccgtgtagtgcatttagtagatgagtttgggttatgaggggttgtaatttaagacctcctctgttcacatctccaagaaattacattaagtttcaaaactttatacttgcccttaattcttgtgcctttctgattaagatcttccttgttttttagtttaatggtgtgaaaattctaaaaagctcagtctttggtaatcagtagataaagaaactgacagaaaacttaatgcattaacctgatacttcttttctttccacaaaaaattgaaatgttataattgtcacaatttcaacttacttgattctttgttattaatacctctctgtaaaaatgtgaagttctgttgacattgttgaggtgaatgtcttaaaagtgttgccctgatttgctgccaaatgtctttttctgatttatgctctgtgagtaccagcctagctatgcattaatgtgctctctgtgaaatgcttctgctttttgtacaaactattcttaagctatgctcacgggaatgaaggacaggttgttttatttcaataaggtaagaatgctttacatttaaagaaagcttcaaaaaacaacctgtgtcaattatacattaaatatcaggggtttgaaaccagttttgaatatgtgaccagaaaggatggtttgacttttcaaaagaatttccaatatcttaaaactttagaatttatctcgggttaggtgggcaatgtttagactaagttgtttcaatgctttccaataatacttttcataaaatttcacagatttagggtggctagctattgcagtaatacagtcttataataattaacgacagaatgttagaagcaaattgtgtgatttgcatgacttatgaaatgcagatggtgagaagtagacttggaagctttttcagggtgcagatggacacaagttcttcagtgaagttaattaaaagtaatcattgtatagtaaccactgtcttgtaggctgctaagaaattagtattctactttcccaaatgaaaatgccagatgatgcctttccaggctgtgggaaatatctttatcacctgtagtcatgtcaaaagacgcattcctcttcccctttcttcctccatctctagatttcatacagatgaataaaattaaagggacaaatactagtaggaagcactgtatatagaagacaatacaaattatctgtagtactaagttgggattggaggttgtggtccattccacatcctgtcctgtatttgtatgtgtgtttaattcatgtgtttacttctcaaaccctttattttaaaatggagataattaaaatgtgttttatagtgaatagctgaggaataattaatatatagtccaggcagaaatggaataacattctgacattggcaaaaaagaatttattactgtacaggatttaaaatgatcttaatggaaaagaattttttaagtattccagtttagaaataaattactagatatagctcacatgtgtttgccttatgatatggcatgaaaataagattatactgatttaaaaatgcatctgggttatagatttcaggtggctggctttgttttgggaactctttcccttttactaacttctgtcatgtagccacttctttttctaacagctgtattggagtgtttctcttcgagtcaatgtttttacttatttgagtcaaaagactacttaactaattttgcctagttattagaatggtatattccatttttcctgccagggaactcaatacaaaggtcctaaagcattgttgttgatgggtccaccaaacctggctaagtcctgaatcagtatagacctcatctcagtagtaaaccgtgtatatcacagtcccctagtacttctcagcattattttatcacaaagtttatgattatttaaattttatttctcaaatcttgtcagaagattggaatgtaagagttttattataaaaggtttattattatacatagtgatcaaaattattattaaacactgaatctgtgcaatgaaaatgataggtacttagcactagagctccatttaagtgacagaaatgtattgacttttcataggaaaaacaggcaattgtaagaaacaaatgaaccaattcgtttcagcttggatcactgaaaacaagagagaatcattggcaaaacaatgccttctcattcatgtgtcacaagtggtacttggattgaggacaattgagaagcattaagactgcaaattagttcccaagttgtgtagaatagttgtttgaaagtgtactttcccaaagctcctatgccagcttttaattttcttattaccagcagttttgtttttcttaggttttacattttggtctgcatttgtgttttccttataaaaatgctctatatatccaactagtacatcttgtgtaaatgatgtcaactcatatataagacttcattttgaggaattttaaaaatacacaaatttattaagagctttcttttaatccgtataatagtgtaacaatgttgaccttaaagcttttcagaaatattcaccatgattttgttattactacttcttcaatctttttgatattgacatgtttctaaacgacagtggatagtaagatgtcagattttatactttcattcaaactttgaagaccatttggattttttgggatgatcggctctgagccattcataactcatttgttaaaaacacataagtcttcgagtaaatgaatgccttgaaaaaaaaaagagatcatgtggttgagacagctttacttctgtcagggttacctatggtagggcaaattatttgggtttctggttttctttcctataaaagaaagttggatgatatgatcttaaaagctgtaagatttggtgattataagcttttaaattcatgttcatacttggtttataagtgatgaatgataaacattcttgattttctttacatctacttttatgaccaccagtgacagttgggccctctgaatttttcagtttaagtttttttctacccagtaattaaatgccaaacacgaaactgtatgtgctttacacaaagatttgctatgtaacaaaagtggaagatgtattttttatgttttaggtggatttgaatgcccacagatctaggccaccaatgccagtttacctttacagattctgtttggcaaattcctaagacattaggttacaaatctttctcctttctcttttttctttcttttttcctttttctatattctttcaccactgaaaacttttaacagttacaggttagcaagcatatcattgagcaaatgccctccagcctcttggagagtcttaactattcacactgtcttctctgcctgccccttggtaatatacaaaaagtttcaggtggctgaagccctaatatattaaaaacaaaaatttgaattctaaatacacctgtaagagcaaggaaaacataaattagaatatgtggtatatgtaaattgatatggagtatctgaaaaaaacagtactttttgttcttggtggtcatatttaaatcatacttttaaaatcaaaagtctgtgtaatatgatagttctgtaagttatatctagatgtctgtgaatgcatcaaacagatttttttaatgcatggagtacaagtacaacctttaagttcttagtgaaatttatgcctatttttatcaaactttaacatgtatggttttattatatttaatgggcaaatttgaagcacaaactcaaatacagttcttgtgtccgttattgaaacacatcatcatttaaaacagtttgtaacattttcttttataaaagaacatgctctatacactgacactcttgttctctgcacaatctatgagatgaattgatagctagaatgagaacaaacttttagaaatctcttggccctatgccctcatgttacttgtaagcatctgagctcggagaggttaaatgacttctctaaattcatgtatctttctagtagcaaaattagtatggcaaataactcagtatgaaagctcagaaatagtatgttgcatagatcttttcattgtgaggacatcctctattagaaacaagagaatgagttcttttgatcactggtgtcaaagttagaacacgtctttattaacacatgcaacaaacctacttcatagaataatcccctcattagaaatgtttgttttagatttcattttatcataactgaatgtaagattctgaaatgccaaaccccatttatagttaaaatgctattaactgctagaaaatcttctcctgatggtcttctaatctctgtgggctatgactcaatgattttaaatctcattttctaaagctttgcagattgttaacgcagtccagtgcaacaggattaaacacaaatctgaacacaccgtactttttgaggtccgtttagagctgaataagtggtttgctgtgctgaataatttattgtaattcactttaataattttccattttaattatgagcaatatacatgcacctaaaactcttaagtgtgaattttttgacactttaacccttagctgtctatattatttaagtaacctcattcacactactggaattaatatattagaataaattggtcccttgtgttttataatacaagtagctgtctatgatacaccaaaaaagtacatttgataccacatgttctcactcatatgtgggagctaaaaaaattgaatacatttaagtagtgagtagaattgtggttactagaggatgggaaggggagtggggatggggaattgggataggggtttgggagaggttggttaatggatacaaaattacagtcagatgggaggaataagttctagttttctgtagtactgtagggtaactatagttaacaataatttatgttttcaaatagctagaagagaggattttgaatggtcccaacacaaagaaatgataaacgtttaaggtgataaatatgctaattaccctgatttgatcattacattgtatacacatatcgaaatatcactctgtagcccataaatatgcacaattattacatgtcaatttaaaaagtgcattttgaaagatcaaggctgctgaattattttaaaatttattcagaaagcttattgattttgatgtcctccttttgtacctattgtatatattacttacttctatatagtagactttatatcatttaaactgttctgatttctgtctctttccaagattccgacatcctagtgttataaagcctcaacaattggaatctcaggttttacaaaaatatttgtttaaaatgagagtaattatagcagtgtgatatctgcatttatcagtgctttgataaggtgtgtacattgtatgcatcatagtgaaatttctggtaattattttaataactaaaagtatttaacaaaatggaaacaaatacattaatagatttttcaaatttaatatttatataggtctcttgtactatgtgtgctgtcaagtattcaataagtgaaaatataaaatactttttttcaccactataatgtcattgtatgatttttattctacatatttctctaatggtacttgctatcttttacaaactacttctgttgcatgttaatttttaggtattgtatttttcaagatttatcatcttttaaggaaggcaaaaacatgtaacttaatcacttgaaagtgaactgtgtcattatgcacattttctgatagctgctgtcaaagataaaataacacttcctgccaccataagaagtgtggtcacctcaggacagcactgagtcatacatctggggccagtaggaaaagttagcatcattggcagccgcctgggctcttcatgttccatggaaaatggcacactggcgcatagtgtaacttaaatatttctcaaatgcctaactccttggaaaaattaatgttaagtagtataaaaactgaaatctatgactttatattgaaccagcggttttgagttcttaatttaattatgcttgttccacccatttgtaattctgatttagtttaactaaatttaaattataacttgatatgttaaaatgaaagcaccttgtatagtaaagaacttaagaattgagtcgttactgtatttttttttttaatgcgttaaccactctcaacctaggtagcactggaatatgacccttaatgttttttcctgtctttgtaagatactgctgttaaaatttaacttagatctctgctggacttggaatctatatgtatatctaaagtatttatgcaattatacagaccagtaatacaatattagaaaacttggttgattacccttcataaataccagtagaatttggaagtacagaaactgcccacctccatccagtcaaataaataacctgaaagcataaacgctgtttagaagtgttttcttaatatgacttcaacatacttaaaataagtacctataaaaaacaaaatctttaatccaatggctactttctgagtatatattatcaggttataccttataggtattttttatatggaagtaacttgcatatccttcaaatgaaaggaaatttattttacagtcagtagtccctctatctttgtagtcttacttgaaacacatagtttactaattataacagtgctaattctgtatgtttgggtaatatttttatttgtatgtgagttagttttttaatagtaaaataaaacatgttgctacgtacttagatgttttaaaaattttctctaaacgtttaatccattataaaaacctcttaggatagtgcagttattcttttcattaggggatcagaataaccccattctaagttttgtcagaatctttaagtcacattaacttgtacttccaaagaataggcctgtcagggctgtctaccgtgactattgtataactaactaccaccagcatacatcgtcactacattacagtgtggaaaagtgtggcctttgaagccaaatacacctatatttaaatgccagctttgctatttattggctgtatgaattttggtatataataacctctttgagttattcaattttctcatttttaaaatgaagaaataacacctacctcaaagagtactgaggtttaaatgacgtagtctatgtaaaagatgtactaagtcactggcacttagtacattctagttcagtgttggctattattagtaccaccaccacctataaagaagagttgtagtcagggggtgataatatatgcaaagatcatagtagaagctaattattgttacaaccaggcatcatgccagtaacctgcaattaattaatactgtaattgaagttcaatgaaataatgtatttttgaggcattccaatttaatttcactgaaattacataacgaaattagagaaaaataaaagattaccgagaaaatgtatatagaaataaagagcccaagaatgggcagctgaactcaacatggcctgctcatacaaaaatttctgattgtagagtgctttgtcttaatatacttggatgccccattctgatcattaaaaaaagtcatacttctgaaatgtagaactccacataatttccatttggttatacatgatattttattaggacttagcagtatctgaatttctgaagactttaagaatagtatttggcacatgggcacaataaatatttctcaaatgaataaatgaaggaaatcaccctagttaataaaacttgatctcaggcaactgctactactcttaaacttttgtgtcatatgtaaatttaggggcacggccagaaatattgtaggtctccttttttttcctcttcctccttttcaagacctaagaaagatacattttatttaagatcagatatttcctttttatatgtttgtatagattaaacatttctattgaaaactgttctatgaacaaaaagttcataggttgttgcctgaatgaaaaaccaaatcaaaatatatagagaaaatatttttcaatgaataaaatgccttaattctttttggacaaacttgcctaaatttagaggtttcattatgtgtgggctgaaagggcagatgaaagatcacattttaaaattttatgtttcaatgactcctttctttcttacttccttacaagtgttttgcagtgctagaagtatgcaagtagagttttaaaagattttagtcctttttagctttgaagtccaggaatttaaactataccttgttcaagcttgttccttttggccaagatatatctttgctgaacaatgatttgttaaaataggatttctattataagccaggatgtcagcaatactaatagtattagaatgaatgagcttagaaaactgggttaagaaatgatcaggaagaaagtaaggaggttggatagtccactataaataatattaaaatagctgaaaattttctgtaagggtagatagcaaccttttgactttttaatgttatgtggttaaaaaaaatcgtgtattttaaaattggaaataatatgggtttgtatttcttgatcattatctaaatctacaaacatttaaccaaaatggtgatggcatgagctacaaagatctggctctaaaataatttattttggcctttttcaaaaccgaacaaatatcacttctgggttcgtggcacatcatttttcaatggcccatttttcccctttcctttcataattatgtagccctggagtgagagtaggtatgtgtatacatgtgcacctatgtgcctatttcagtagtgtactaagtcctgtctagagtagagaaacctatataacatacagcaatccctatcttttggttaatttcattttaagaatcggtcagagcaaacattttcttttttaccacctttgtttttagatcactgcacagctcattctggaaggaacaaagaaacagaaatagcatagtctttgatcctgggaaacttctaatgtacaataaatgtaaaactagatatttgtacaaacagtaaccattcatgctgtgcctattaagtgtcagccacttttcatactgacttgatttggacattgcagcagcatctctaggttagatgttattaaccaattttaaagatgaaacagattaaaaggacttactagtaaatgacagattcaaaactcagaacccagggtcctctgaatcaatagaccatgcattttctctcaaacatatggtctctcaaattaaataagaacacctacccaatagtgacccttatttttctctagttcatcttacctgagttcaaagaagtgcttttctactgatcaaaaaaggataaaaacagggttgccacatccatacatggttgtgtaggttagcagtacataacctgcacaactctatattgtgtcattggataagtaaggacatagagttgcaaacctagggcaagtaaaaggaatctttataacacccctatttttgtttattcaatagaatttggaaaattagaataaattaatatttttaaatgatttttaaattttcatatttaggtaatgcaaatgtttatgctgaagactatatttgaagttatgaacaacttaggtttaatattttaaaacagtatgtttgtatgattttttcatttttaatctagcaactaatatgaaattttagtggcaaatgagcacatagattatattacaacattttacaaataaaaatacatttttagtatcttagaacgtgaaactagttgacatttaattagctcctatttatgctaaaagagaggataatgctaaaatagtaaataaatatttttatatttatttgacataattttttgtgcctggtttaccgtcttaattatgtttaggacataattcttaaattgatctgttgaatccttaagctcatgattgaggcaaacctattaacaagttcatcaaacctgtgaacaggaagagccaggaaaacactgaaaaactataagggaagattaactttaccagacattaaaatattataaaacctctatcataaaaacagtatggtgctggcccatgcatagacagatataccagtggaatagaatagaaagcctagaactagatcctggcacatatagaaatttactatatgataaaggttgcatctcagatcattggggaaaagatgtttgtccattgccatttggaaagagagacagttaaataccttgcagcttacacaagaatagcctccaagtggattaggtatctaagtgtaaaaattgaagccacaaaagtactaaaaaacccaagatttttacattggtatgtatttctagggaaaatttcacatacaataggaaaattttcttctaacatggcagactctcccccacctcattttgcagatgtgattatttgcaggtaacaggcataggggaaatcagttctccctcagtattcacaatcttgtcaccagctacatgtattctctttaaaacatcactggcaaaattataaatttatgctgttattaccttttaagagtagactcactcctaattaccatgatttgtttatatacattaacaaacagttctaccctaaattttatcatacgaactttagtgtcaattagtctaacttcataaaatatcaaaggtaactccgatttcatgacggtgagatatggaaagtatgttaaattctactgtgactatgactgatgatcgtaaagtttagttatagagagaaaagagttaattggtgattcttcactaaatgtaagtttcagaaggaaaagatcttacataaaatttatagaaacccacaaaagttaactttaaatctatattgaattttaaaataaagcagaaaggatgctcattatgccagcatgtattaaataccttctgtgaactaggttctattctgataatacaaaaatggcatttagtcccatagctggtcttactattaataagtatctgataattaaatgcagaatcttaccctaaataagggttattgactccaatgtgtaagtttctgttctttatacagctgctatgttatatttcatgtataccacatgctacttggcagaacaaagggtaaactacagtacattttaagtaactacttccaaaaaatagcattgtatagcaaacagttccacatgggatctttcattgcagcttctattttcataaatagaaacatgcagcaatatgtagctaagtaaacaaaattgcaagaatagcttaattagttgaaagatccagtgtacctaatcacttacctttcatagaatttgctttgaagaaaaaaaatagcctattctgggatccatagaggagagatgcaagatgcttctataagaaacagtggctcactaaagcctaacttcttaaggagtaaagcaggagaaagggggatgatgagattttatcagaagctagggtttatgtgtgtacagtttttaaaaagtcccctaagtgtcttttaacaggacgatatttaaaatttaatgttctgtctgtcattttttcccttttgtggctactcgttgtatcttgcttgggaagacattttccatccctatattatataaatcttttcctgtatattgtcccaatatattcatttcttaaaacctttagttagctttttattatgtaatttaaaaaaatgtgcagtatattctggccaggcatggtggctcacacctgtaaccctagcactttgggaggctgaggcgggcggatcatttgaagtcaggagtttgagaccagcctggccaaaatggtgaaaccctgtctctactgaaaatacaaaaactagtcgggcatggtgatgcgtgtctgtaatcccagctgcttgggaggctgaggcaggagaatctccttaagccgggagtcagaggttggagtgagccaagagtgtgccactgtactccagcctgggaaacaagagcaaaactctgtctcaaaaaaaaaaaaaaaaaaaaaaagtacaatataaagtagaggatctgacattacttttttcccagatggagagccaggcgttctaacacaacttatggggtaattttcccctcacttatttgaaatgctaactttataaaaaatcaaaatgataaacctcaattatgtaaactaaaatacaaatgcataggtctgtttctggattcttcctttttggatatatttatccattttctatttcattggaattttgaattattgttactttatagaatgtttgctatctgaatggcaagtttcctcacccccatgttttactttttcaaatatttcttgattactgcccatttttcctttcatgtggaatttaggttcagtttgtcaaggctcacacaaaaataatctcattaggatcttgactaggatttcattgaatttataggttaatttagagaaaattaatatccatatactattgggcattcttatccaggaatgtgctatactttcttacttatttggatcttcttttatatccttcagtggaatttgatagctttttaaaaaataaatgtcatctacatttctctttaggtttattcctagtttattggttttttacctattgtgaatagaatttttttcattacattttctaattggctttgctgagtatggggaagttattgaatactgctcttgtatttgactaccttaataaacttgcttattgttctgtgtttttcagttgattttcttggtaaattttctttggttgattttcttggtatttctaagtaaataatattatgcatatgttgatagttttttatcatctaatatccataattctttttcttccctgtctgcgtttgctaggaccactgctcaatgttgaatattcttgatctttagttagtaagaatgctgcttgagtttcactattatattgattatgatgattttgaattgttctaaatgtgctctgcatttgacaaggtctggttaattgatatattaactttcaaatttgtaattaagttttataattaaaaataaatatatttatataaaatcctaacggttcagaaaagttagttttaggaaatgatcattcatgattcctgaggcttaagggtttagcttgctgtgtagattctacatagcagagtagcgtgtagattctacatagcagagtagcatatagactctacagagcaggcccagggtccccagcccttgggctatgaaactgtactggttcatggcctgttaggaaaatgggcggcacagcaggaggtgtgtggctgatgaacgagcactacagtctgagttctgcctcctatcagatgaccggtgccattttagattctcataggaatgcacactgtgttgtgcactgagcatgtgagggatctaggttgtgcacttcttatgagaatataatgcctgatgatctgaggtggaacagtttcatcctgaaaccatccccccattgcccacagaaaaagtatcttccacaaagccggtccctggggccaaaaaggttggggactactgatgtagaggatgagttttcatcttttatttgaacttggtgacttagtttaccaagtaacttgctttcagatcttgtaataaaaatgtagttttagccataaaacatctaattctgttttgagctggtagcagtttatatatatatgtactgatgatatgattaacatttttattgaactgctcaggagtctaactatgtatctccattatttagaaattttctgaaaactgtttcatgcattcctttggaaattcataaagtaagcttctgagaataaagaaattgagagatatgaccactggaccactcctagctgggccaaaaagtattccataaagtttatgatctcccctctccattcctttctgtcaagatcagaagaggtaggagtaggggagtcaatatcatgtctctttagtttgtagaaatcatgatttgaaatacaagtttgtaattttcttgaggtcttctgaatattaatcctgttgccaaatcacagatcactttccctgtacatatttaaaggaaatatttttatttcgttagctaatgtaagtcctgttttttaaaaaacgaaagttgttctttatgctgtcttctttttttcttaacaattaaaccatgaaacaaccataagttgaaaagtttcattgattctgctcctcattgtaacagttggtgatttggtggcattagtaggtcatagtcatagagtaacagtactcttctccaatttgacagactaggttaaggcttttggttttggaatatagattagaactatattatttctaaaataaatcttaatgctgtaagatgtttggaagcaaatataaaactgtagttaatgttgcactcaggaattattagaaggttgaagtgaaggacaaaagaaataaattttattacagaaaacatgtctcctaattaagtattcattaactgcccaaagttgaacttgttaacctcaaggttggaatatactctatgtgttggagaatagatgccatagtagaacctttggtagttaagacagatgtacctgggctatatttcttccagagaatactagtttctcaagatcagctattctgtttcctatgctatgctttttattattctctagtttctttttctttttctattgtgttctcacaagattatcaagaacccctcaccccctcctattcaagcagaaattttggttgtttttccctccttcttggcaagatttgggattgtcatgaaaagtaatgaaatcagctcttttatatataaaattttccatggatgacatgactcagttttgaatagaaatgcaaggttccattttgaattctttaccttttttggattatagcactgctaggtcaagatcagagcgctttgttcataagtaaagtgtataaaacgtaacaggaacttaaagtttcctttatcattattgaatgaatcacacacttcttaaatttttaatctgtggtgctataaccaaaagaacatgtttcctgggaggctgctgacaataaaaagtaattgtagattttcttatgttgttacatattttagtatatttcttattttcttttttaaaataaaaagttcttattcactctaggatccttagaaattttttccatttctagaaaaatatcttgaattcagtagcctgctgtttaaagttatcatgagtagtgaactgttgcctttgggaaaggagcattttgatccaactatgcattttaaatagaaagataatattcatctttcccatatacattaatttagaaatgtctaccaatattttctatacctttcacaatgattatttgcaattcttatcaacattagcttttactttttatatttataatatttgcaatatatagtgcaggaaattcccattaacctgtggctactcaggatgactctcactgagttgttggtttctttcacaggttgatttacagctgtcttgagtataattctgtgtagcaggcaatggtagtgtatttatatgtatacagatcttgcatccatcaggttcttctcattgaaacacaccagcggagagcttactaaaagattgtttgcacagctgctttcaggcagtgaccaaaatttcctaggaaagtgagtgaaaatacacttgttgagccaagctcagaagtttcttggatagtgctttacataatataaagtcattacatgtgttggatctttgcccttatctaacctcccccaacctccactccactccactccacgttcttttttgtcttgcttagtctcctttccctaggagaagagcttttgtttacccttttatgtcttgtgaagtcactaaaaaagatttgtcttctcatatgacatcagtatctaaggaccttcaattacatatcatgttagtttttttttaattctgagacctaagtgaagatgatgtccatatatttttgtcctcttatagactcctatctatgaaactaggtttttcagcagtaatgtaatcacaggagaatcgtaagaacattaagctcctttaactgttgggttgccaacaatatgaatgtggtgttaaatcatgtcttggactttacaaatatcatctaaaagttagttcttaaattcctggcaaggaatttacactgtgctaagaaacagatgttatggagattaatttgtgactggagaagaaatgtctctgtggtaagagatgagtacaggttctgggcaatccatttgacttttaaatgtaagaatggaattccaaacacttaacacattcagctatatgacagaaagtaaatctatggatatggtattttgtgaatgatcttttaaataaaagaaaaccttacataaaaaatgaaaaaattatatatatatatatatatatatatatatatatatatatatatatatatatgtctgtcagactgtttcttagtcacagtattagtcaaggtttgctatccactctccccaccatcctgattcaaatgcatctgcagaagtttttgctccttcctttctgagtttcaggtatttcttctgattcctatccacttgtaaaatttggagtctagagggaaccaagggaaagcagtgattacaactgacatcttccagtttgattggtgaaaggagaaacctcacttccttaatgaacattgatcatagtaaaatgctgtcataactcaggagaattttgctaagcagagaggaattacaaaaaatattagaatacatattttcagagttctttgagaaatatttgataaggaacatgaacttgtttgtggtttcttttttgatagagcttctgcaacattcttttagaattaataacagtattgtgaaggttgaggctaatttttcgtttagcctggtgaatttctccacaggcttcacttttgggaaaataaggaagttctctaagtatccataaaacatgaaattagggatttattcaaataaacataattaaaattattttggaatagactttttctctccatttagttgtaataatttgtctagcttacagttcctttgttgtctatagatgtctgagaaatatttgttaattcttgggtatcattatatattttctaattggggctggcaattacaaaaacggcatagctaaataatctagaaacataagcctaattgtgtctgtgtgtgtgtgtgtgtgtgtgtgtgtgtgtgtataaccaattatcattattgtcctatttgatgacttcatcacttattgaaaaaaatcaagtctctttttgcctttgacaagtgttgctctagtaatgtgaatattttggagcttgttagaaatacaaaatctcaggccacactccaactaaatcaaaatttactacagtttaatcagatccccagatgttttatatgcacataaaatttaagaagcaatggaaaactgacattgttttgagtagtaattagaaatttgtaattaatttataattttaaaataaaattggaattattttgagaaagtcttataaattttaggagaataaaacagggccttcaaaataggctgttttcctgggttaagtaaaatttacttcataggtgaaaagaaattatttggcttttaatttcattatgctatgttacaaattgattctgatatataaagcaaaacaaaaaattgagtatcaccacttatattatttttaggaaacatgatcagaaatggctgttgtacgaatgtaggattctttttatcctaacattaaatccttacttgtgataagatactaacattcatagctttattttaactttaatattcaataaaagtaatgatagtttagtgattagatggagagtacatgttgactaagtatttcagttagcctagtattttagaacacgttttaagagtcaaaaaattctaaagcaccaaaggattgtgtgtgtgtgtgtgtgtgtgtgtgtttgactctgtaaacttattgagtagttaataatgctgacattcatttatagtgggcaaatgtgtgtttgtgtgtgtgtgtttgtgtgtgtgtgtgtgtggatttgaaatgatgaataagatttgttttgtattagggaaggatcacaggggatatatttagattaagtttaatagtagatggtgccctttgtttctgcagtacttttatactaaacttttcttttgtggagattatttcagtcatatttaataagatgcatatgtctgaattaatatgatcggctgtaacttctaatggcagtttttttacctctatattactatacagttttttctggaattaccacttttgaaggtaatttaccttttaccacatttttctgttgattttgaattctttttcaggagacaatggatatagttctaaataatgtatgaaataagttctacttgtagatcttttccttaacttcccttactaagaggagagtaagaggaattttagataggcgtagaggaataaaatggccaaagaaagatcatgtgtagaaaagcttcaacttgcatagctaaaatagcgaaccaagtggagatgccaagcacgaagattacaaccaaagatgatcctttctgcggcaaaaggcaaactggccacaagtcactgttctacacgttgaaaccagagaagagtttttcagaacgtgagtctgaacacagccttcagtcatggtggccttctttcagtgcctcatactctcactcctgtctccaagctgctgagtccttgctgttttcagggtctaatactctttcctccctctttggctagttaactcccagtcatctctagacctcagttcttgccacacttctcccagaaaacttactcctgatctctctgacatggtcaaatcaccatattatgggctcctggagcaccatgccaggtacctttactttccttcaattacttgttagggttgtttgtgtgattacttacttaacatgattctctctcaataaactattacctcagtgaaagcaggggccatgtccgtttctgctcacttttcttctttactccctagaataatgcctggctcaaaaataggcattcaacaaatatttgttcaattaataaataaaagttggtatcaggaattagaaaagcagtgagatgagcatcctgatactagggacaggaagggaagcattccttaggaaaatcatatagaagtctgtgttgtagaagaataaagaacaggcagttattgactttggaacctagtttaaatctaaaaatatcaggagcattagggaagcctgggactgagataagccaagattagacgtgtcctcagaagtaaagttggatcaacaagtttgccctttacaatggcaagtctccagcattgttctcattaccacttcctcttacctcccacctggaagactgtctcctcttgcccgtgggcaagtcctccttggagaagatagtttctcctggcaccttggcaaagatgactgactaattcttcatgacacgaattactttaaaattcatctagatgtcatttagatacaaaattcttttttcccttgatatttctagtgtacaattttcagcatgtcctcactcaatattgcttagatattaaatggaaatatttaaaaagatagccgtgttaagtcccatcatgattaggcaattttttcatggtgaattaggattgggtaagacatcatactgatgacttctatgtagaatatgctaaatttagcaaatcattgccactagtggtttctttgtattcaatagaaaagaaaattgtatatctattagtgaagtttgattacacataggtggacatagcattcgtaatcagatgtaaaatagtaacttacagctgtggctttcacatacccatatgcctcccaaaatgcttaggtctaattaaaatttgaaaggagcaaatttaggctatttaaggttaatctgttggttaatttgtacttcttattatagtaaaatatagataacataaaatttgccattttaaccattgcatttttaagtgtaaaatgcacatatcatcaaacgtactatcttaaccatctttaagtgtacagttcactggcattaagtacattcacatttttgtgctactgacctcagcatccattcacagaattcttttcatcttgcaaaactgaaactctttactcattaaacaacaatccctattattcctcccctcagcctctggcagccccattctactttctgtctctgaatttgacgactgcatgacgactgcatgcctcatataagtggaatcatacagtatctgtccttttgtgaatggcttatttcacttagcataatgtcttcagggttgatccatgcagtaccatgtatcagcactttctttttaaggctgaataaaaatgtatacacattttaaaatgtgtatacaacatttaaaaaatatttttaatttttatgggtacatagtaggtgtgtatatatggggtacatgagatgttttgatacaggcatgcaatgtgaaataatcacatcatggagaatggggtatccatcctctcaagcatttatcctttgtgttacaaacaatataactatattattttagttatattaaaatgtacaattaaattattcactatagtcagtcgactgagtgactctactatttgctgtcaaaaagaatgaacttattcattctttctaaatatatttttgtaagtattaaccttctccaccttcccctcacctccccacaccactagccttccctccctttggtaaccatccttctactctgtttaatttttagatcccacaaataagtgagaacatttgatatttgtctttctgtgcctagcttatttcacttgacataatgatctccagttccaaccatgtcgttgcaaatgacaggatctcattcttttttatggctgaatattactccattgtgtatatgtaccacattttctttattcacctgttgatggacacaagttgcttcaagatcttggctattgtgaacagaactgcaacaaactgcagaactgcaacaaatccctatcaaaataccaatgacattcttcacagaaatagaaaaaaaaaatcctaaaatgcatatggaaccacgaaagacccagaatagccactgggtcttctgggacccagtgcagatatcttactgatatcctgatttcctttctttggggtgtatacccagcagtaggattgctggatcatgtggcagctctgtttttagttttttgaggaaccactaaactattctccatagtggttgtactaatttacattcccaccaacagtatacgagggttgccttttctccacatcctcaccaggatttgttactgcttgtcttttggatataagccattttaactggggtgagatgctatctcattgtagtttttctttgcatttctgtgatggtcagtgacgctgcataccttttcatataccttatggccgtttgtatgtcttttgagaactgcctattcaaatcttttgcccatttttaaccagattattagatttttttttttcctatggagttgtttgagctccttacatattctggttgttaatcccttgtcaggtgggtagcttgcaaatatgttctcccattttgtgggttgtctcttcactttgttgactgtttcctttgctgtgcagaagcaaaggaccccatttgttcatttttgctttggttgcctgtgattgtggggtattactcaagaaatctttgccaagaccagtgtcctggagagcttctgcaatgttttctggtagtagtttcatagtttgaggtctttaagtctttaatcaattttgaattttgtatatagcaggagatacagatctagtttctttcttctgcccatggatatccagttttcccataaccatttattaaagagactggccttctccagtgtatgtccttggcacttttgtcgaaaatgagtgcactgtgggtgtgtggatttttttctgtgtactctgttctgttccactggtctctgtgtctctttttatgccagcaccatgctgtcttgtttactatacctcagtagtataatttgaagtcagttctgtgattcctccagttgtgttctttttgcttaggatagctttggctattctgggtcttttgtgattccatatacattttaggatggtcttttttctatttctgtgaagaatgtcattggtattttgatagggattgcattgaatctgtagattgctttgagtaatatggacattttaaaaaatattcattcttccaatccatgaacatgaaatatctttccattttttggtggtttcttccatttcttgcatcagtgttttatagttttcattgtagagatctttcacttctttggttaagttgattcctaggtgtttaactttatgtggggctattataaattaaattactttattttctctttcaggttgttgactgttggcatgtagaaatgctactgatttttgtgtgttaattttgtatcctgtaactttactgaatttatcacttctaatagttcttttgtggattctttaggtttttctaaatataagatcatctcatcagcaaataagaataatttgacttctcattgttcaattcccacctatgagtgagaacatgcggtgtttggttttttgtccttgtgatagtttgctgagaatgatggtttccgaacacaggaaggggaacatcacacaccagggcctgttgtggggtggggggaggggggagggatagcattaggagatatacctaatgtaaatgacgagttaatgggtgcagcacaccaacatggcacatgtatacatatgtaacaaacctgcacgttgtgcacatgtaccctagaacttaaagtattatatatatatgatatgtatatacatatatacaatacatatatacatatatacacacacacacacacacacacacacacacacacacacatatatatatatatatgaagaataatttgacttcttcctttccaatttggatgccatttatttatttctcttgcctggctgctctagctaggacttccagtactatgttgaataacagtggtggcagtgggcatctttgtcgtgttccagatcttgaaggaaaggctttcagtttttccctattcattatgatactagctgtgggactgccatatatggcatttattatgttaaggtatgttccttctatactcagttttttgggggtttttatcatgaagtgatgttgaattttattaaatgctttttcagcatcaaatgaaatgatcagatggtttttgttcgttattctgtagatacgatgtaccacattgattgatttgcatatgttgaacaagtcttgcatcccagggataaatacttggtcatgatgaatgatcgttttaaagtaatattactgtattcagttgctagtattttgttgaggttttttgcatcaatattcatcagatatattggcctgtagttttcttttttcaatgtgtctttggttttggtatcagggtaatacttgcctcatgtaatgagtttggcagtattctcttctatttttcagaatagtttgggtcagattggtattagttctcctttaaatatttggtagagttcacctgtgaagccattagctcccaggcttttctttactgtgagactttttattatggcttcaatctccttacttgttattggcctattcaagttttggatttctttatggttcaatcttggtaggttgtttttgtctagaaatttgctcatttcttcaagattttccagtttatcagcatgtagtttctcatagtagccactaatgatcctttgaatttctgcagtatcaagtgtaatgtgtccgtttttacctctgattttatttatttgggtcgtctttcttattttcttagtctagccaaaggtttgtcaactttaacttttcaaaatgcgaattttttgttttattgctcttttgtgttgcttcatttcaatttcatttgtctatggtcttatctttattatctcttccagtattttggttttggtttgctctcttttctagctctttaagatgcattgttaggttgtttatttgaagtttttcttcttttttgaggtaagcacatataactataaatttccctcttagtactgcttttgctatatcccataggtttttgtatgttgtgttttcattatcatttgtttcaagaaagttttcaatttccttcctaatttcttcattgatccacttgtcatttggaaatgtattgttcaattttcatgtattcgtgtagtttccaaaattcctcttgtcatcaatttctagttttattcttttgtagtcagagaagatgcttgagaggattttagtttttttgaatgttttaaggcttgttttgtaacctaacatggtctgtctttgagaatgatccatttgctgaggaaaagaatgcgtattctgcagtctttggatgaaatattctatacatgtctgttaggtccatttgttctatagtgtagataaactccaacgtttcttggttaatttctgtctggaatatctgtcaaatgctgaaagtggggtgttgaagtctccagctattattatattgggggttctctctctctttagcttcatttgatatttgctttatatatttgagttctccagtgctgtttgcatatatatttgaaattctcttgttgaattggcccctttatcattctattattttgcctctttttatagattttgtcttgaaatctatttttcctgatatgagtatagctactcctgctctttttgggtttccattggcttggaatatcttttccattcctttactttcagtctatgtgtgtctttataggtgaagtttcttataggcaacaaatcactgtgttttgttttgttttgtttttaaatttatgcagccactctatgactttttattggagagtttagtccatttgtattcagtgttactgttgataagtaaagacttcctcctgccattttgttatttgttttctggttgttttatggtctcttccttctttctttctttctgttctatcttccttttagtgaaagtgattttctctgttgaaatgatttagtttcttggtttgaggttcccatgagccttgcaaatactatcttaataaccattattttaagctgatgagaacttaacactgtttgcactaacaaacaaacaagcaaaaagaaaagtaataaaaactctatgcctcaacttcatactcccactatttaactttttgttgtttctatttagatcttattgtactgtctatgtcttgaaaagctgttgtagttattatttttgattggttcattgtttagtctttctgcttaggataaaaggaatttacacgccacaattacagtgttggtataatattctgtgttttttttgtgtggttactattgccagtaagttttttacctttagatgactagttattgctcataaatgtccttttctttctgattgaagtacttcctttagcatttcttgcaggacaggtctcatgttgaggaaattccacagcttttgtttggaaaagtctttatttctccctcatgtttgaagaatatttttgctgtttatactcttctagggtaaaagttttttccttcatcactttaaatatgtcatgccactctctgctggcctataagttttccaccgaaaactctgtcatcagatctattggagctccattgtatgttgtttgtttgtgttctcttgttgctttgaggatcctttatccttgacttttggacttgaggtagtcaaggcatttaataatccctgttaaaagactctgatgcatttttcagtatgacaattgtgtttttcagctccagtatttctgcttgattcttttaaattatttcaatctctttgttaaatttatctaatattgtctttgggttaaatctgcttgctgttctataaccttcttgtacttaggtatcgatgtatttctctaggtttgggaagttctctgttattattcctttcaataaaccttctacccctgactttttcctctacctcctgattaagggcaataactcttatatattcccttttgaggtgcctgtaggcatggttaattgttttttattcttgttttaatctcttctgactgtgcattttcaaatagccagtcttcaagctcacgaattctttgttctgcttgaccaaatctgctgttaaaagactctgatgcatttttcagtatgacaattgcatttttcagctccagtatttctgcttgattcttttagattatttcaatctctttgttaaatttatctgatagaattctgaattccttctctgtgttatcttgaaatttctttaagtttcctcaaaatagctattttgaattctctacctgaaatgtcacatatcttttgtttttccaggattggtacctggtgccttatttcgttcatttgatgaggttatgttttcctgaattgtcctaatacttgtagatgtttatctgttgctgggcattgaaaagttaggaatttattagagtttttgcagccaagacttgtttgtacccatccttcttgggaaggcattccagatattcaaaaggacttaggtgttatgatctaagctgtatctgcctcagggagcaccccaagcccggtgatgctgtgcttcttacagactcatagaggcctccttgatgatcttggacaagatctgggataattctctggattacctggcagagacttttgttctcttcccttactgtctcccaaataaacagtctctcactctgttgtgagccacctgaagctgtgggtggagtgagacaagcacccttgtggccaccaccaccatgactgtgctgggtcatacctgaagccaacacagcactacatcttgctcaagtcctgctttaacccctccctggctactgcttatgttctctcaagaccctgaggctctacagtcagcaaatgccaaagccagtgggcttgtgttcttcccttcagggcagcaatttcccccaggccctgggtgggtccagaggtgctgtctgggagccagggactagcatttaaaaccttagaagtgcacctggtgttctgttgtactgtggctgatctgacactcaaaccacaagatgtagttcttcccactcttctctcccctttccaaaggcagaggatccccaccccatggccactgtcaccacaaaaccatggtaagtagtgccaaactaccactgctgtttccttaaggcctgaggtctcttcaatcagcttgtagcgaatgctgcctggcctgggcctcacccttcaaggacagtgggctcccctctggcccagggcaggtccagaaatgccatccatccaagagccaagtcctagaattgtggaccccaagaacctgctttgttctctagccccctatgcatgagctggtacctaaggtacaagacaaagtcccctttcctttttcttctgcttttttgaagcagaaggaattgtgccccgtagtcaaccgcagctccagatgtgctgggtctcacctgaagccaacaagtctcacagtctcacacagggcccttgatttagtacttgggtatcattgctgctttttcagggcccaagggctcttcagttagctggtgatgaatggtgccaggatggggtcattcccttctggaccagggtatgtctaggaatgtcatccaggagcttgggcctggaaaggggccctcatgactctgaccagtgccctatcctgccatggctaagctagtatccaagatgcaagataaagttttccctgttttctcctcaagcggaaggaaggagtctcttttggagccatgagctgtaaagcctggggttagggaagagataataccagcactctcttggccaccctggctggtgttttagtatgttgtgtgtcacccctatccactgtctctgggccctgttcagcattagaactctcctaggatttgcagtccttgtggcctagactgtgtttcaagtttatttatttaaatcctcatagcactttagcccatggtgtccaggtttgtgggaactcaggttccaactgccaggattgatgattccgctctggctagggctggtttaaatgctccctctgtgggtgggcatcagctgagtttggtcttgttttcctttctgctctatcaggacagcagcaagttcaatgcctcacaattgctgtgctctccctccagcacaaagaaacactctagtcaccacgctaccactgcctgggcttcaggaaggtgtggcatcactgatttaagatggtttttttttttttttttttaaggttttcagtgcctttttcagtgatgcgaagttaaaactgggtactgtgagtgctcacctgatgtttggttcctatgagggtgcttttttgtgtagataattattaaattggtgtccttgcggggggctagggaaggcaattggtggagccttctgttctaccatcttgctccacctcctccaacattttctttatctacttatacatcagtggacacttgggttgcttccacctctcgcctattgtgaataatgcttttatgaacataggtgtacaactatctcttcaaatatctgctttcattttgtttgggtatgtagcctgaagtggaattgctgaattctatggtaatcttttttttattttatatttatttttttctttgttttttggagagtagttttattagcttgggatataatgggatcatcactaggagggcagggtattccactggttaccacgtgcagctgtctggggagcatgataaaattcagtccagggttctgtgctggggagcagggccttgaaaagaaggcaaattgtccagggaagtagtagctgtgagggtcatggctaccttgctccactctactgcactggatctcctggtgcttttcaggctcctgtcaatcctgcatctgtatggggcaatggaccatctggcccaaaacttcatcctcaagtttgatgtaggccaggcatttctgcttctttccactggacttgactttgcactcaggattcttcttgcagaaatttatatactggagcttaaattctagccccacaaagttccctgctggggagagtgtatccatagcactgctcatattggtctccctgaaggctcactgcataagtggatgcttatggaatttccccagggtacctgcaggccctgctgctaggcctttaggagctcagccccgcctaatcccatggtgcccagccataggtccagcaggatcagcagctactgcatgggtttccctcagtcaccctggaccttctttcctgtgccttcaagaaatttcctaaccttcaccatggctaaatcttggcctcagctgtcaatctcttcctggtcttctccccctgcacatccctgcccctgatgctctttcctactgtgggggcctgttttcacttatgtacttattttctccctggaattataaaccctgttgatagactgtaacatccttaaagtcagcaaagataaacatgtttctatcttcatgataaccagttattatttggtctacaatacaatgtaatttttttaaatgtattttcagccttgctgtaagaaacagtctaatgggaacttatagttgtgtttatcaaaagagtttattgaaggtgttgtttattacattacacaaggatttcttcccacaagaaatcctttttgctgactttagtgtcaaaaatggatgggcatgtttgaggtgatggatattccaattaccctgtttttatcattatactttgtataatgtatcagaatatcacatgtatctcataagtatatacagttattatgtatcaatttaagaaaagactggatgggcttctccgagaaactggcttgctgttatctaatgaatgttttaaactattaatgtttttcatttgtatgaattttttatattttcattattctggctcccactttatgactaaccatattttcctcatctactttgaatttgtattgccctcctgaattgtgtgtgtgtaaacaatatacttaaatgccttttgatgcaaagcataatttaaataaatatatattaaacaaagaccttaaagttttaatggaaaatagaaaaacatttttggtataatgacttttggtatggtacaaacaaacagtctagaggtttggaaaccatcctttccgttcctccctcactcctaattctgcatagtctttaagagcatggatttagaggcaaatggacttgggtttagaccttgccttaccatttataagctgttggatcccaggcatggtccctaaatttaaattttcttatctgtaaaatcaagataatgatatacagttcataaataatagaaggtattactattattcagcatcaattcttctatatagaattgatataaaactattgaaagtgtagcctttttcaaaataagttaggacagagtaaatgagaacagtcccagaagaaaattatccttccttttaaaattttatttggttttcttgagaatccttgtgaaaacaaatcatatgctacttgttatagagcgactgcttgcttgtaggaggacgactgttaaggatgcctttgaagaacataaagaacaggggtttctcaggtcaacatgtattatattggtatctaaaaactatttgcaatgtttcccctttcattcattcaaatgccacttcagattgaatgccatctgggtactctacacagtattgaattcatcaagagtatgctagcatggactttagtccttggtagttttaattttttttttctggtaggtctagaagagtgtgatttcattagccactgttgtatgttattctttttcattttaataactgtatgtttctatctctctttacccatttatttttgcaagggtatgaatccactttattgttgagatgtgttttttcagtcttgagatggtccgatatagtcgaattaggtttgattttggatcctctgggaccaggttttaattattggtttgcctgtgagttacttactgtgtacacttagagaattacctaatctcactgagctttaatttcttcacttctgaaattggtataacagcagtctctttgacacgacttggcatctttctgtttacttcccatcctcaccattatcctgtaatcttctaaaggaatattctacatgcaaggccttcactttctcatttcccagtcactgctcaatcccgtagtctgtctggcttctctttgccttattctaatactgttctggctaaaatcattgataatctcttaattctcagagtgctttagtccttatcttactagaatgctgtgttgcatttaacacttgtctgtcgtgcctttcttattattaccttgtcctctctgatccatttttgttttcattcttagatgcccctttgtctggccaaccctcaagttgtatggaccactatacctttcaccctatacagttgagggagattggttccaggaacccccacagataccaaactctgcaaatgctcatgtcccttatataaaatagtatggtatttggatataatctatgaaatcctcttgtatactttaagtcatctctaggttacaaataatacctaatacaagtactgcattccttgaggtctgtgtcttatttacccttttatctccagcgttcacagcagtgtctgacaaataattccttcatttttccccttgttcctgactttagagtcttccttttaaaatataaatcctgtttagctctgtgacactgtaattactaccaactccatttagatattcagcacatatttgtaatagtatcaatttacatgtttattttatttacaaataactcagtgaactctcacacagatccataatgttgtcttatagttattaggcagggagtccctcatcttactcacaggctataaatctacctgcatctacacccatcttctcctccttccctcctttttcaatagagatatacagttcttatccacatttaaatatcttcaagtctctaacatctttaagaaagaaaaacagactctctctctcaatcccatattctctagatatcctcttatttttctcttctcttacgtagcctgactgctttgaagactcctcaacccattcgatgctggcttattgccatcactgtgaaaacaactctcaggaatatcactagtgactttcacattgctatatccagtgagaacatttcagccctcatcagtatacacatactaatggagaatgaaagaaaaagaagattgtatagggaggctacaaagtaattctagttactttaaggaattttgagactatagtaaagacatctgtggccttatactagaccctgtcaggaatcacactgcttttaggactgactcattttctttctcaatggctacataatctctctgtttggaaacttgacttccttttgcacatcttttctaatttcatctctgttttttctattctcttataatttctgctcctccataacttcagctggaatgtagccccttatagcctctggtctccctccttgacataatgaggacctcttagtttcagctaattgccttattttcttggtattctttacttaaatttctagagcgttagttttattagtccagttcatcatttgtatcaggccacttcacaggtgattgaaaccgcctcaatctatagcctagccaatcacttatgaattgccctgggtaatcctgatttctacttttggatttgagtaaaatccaaatgataatggattaaggagcgcatcacaggtgaggaaataagggtaagggcttgaatccaaagagggtgacagactagtggggagcacacatgatcaacaaaatcaaataaaggattttgtgttttattttaagatggcagagatttgaacatagaatgagtcaataggcaatagttgaaacaaagagagaatttaattttttagttattgaagttgtgttaaggtggcagaagatgggactacagagtacagaaagatagattagctttaaataggaaggatacctcttcctctgaagtggagtttaagtaagaaagtaagaatttgatgcagataaatttgaaaataggggaacctgcctgttggcatactttatgaaatagtcagcaaggagaactgcacagaagaaagataaagatttccagtacgtgctgaggaaaattcaactaggtacctaacaactacgagtatgatgaagtgattttctttttcactgtagcccatatgtaggttaagaaagggcgaaggatttggctagttcagagttaaaatggacttaatttgtgacatggtagcattaatgcttgcttctaacccacccttcacatttatttggtttgaccatgttttcattctggtctttcatacttttattttgtaggtcttgatgactgtttgcagcagtatattaagaactttgagagggagaagatcagtggggaccagctgctgcgcattacacatcaggagctagaagatctgggggtcagccgcattggccatcaggaactgatcttggaagcagttgaccttctgtgtgcattggtaaggacataaaactggtgaagagggaaacttctctttttcttcttttgttgcttttcccttttttcttctcctcttttgataatcgaaatgcaaatagaagaaaaaaactctgattctcaaccagctggacctgatattttcttccttccttaaatttattatattagtgccaaataacagttccctgtttgtaacatcttttataacagtaagacttgggtatatcagaaccttaagtccagagtgtatgtctcataagcagggctcttcatagatgaaccactcatgtgctaggctctcacactgccagttgagaaaggaaagaatattgattgacagtgttacatacatacagtctagacgtttgaagtttgacccatgaacaaggctctgccgacctaaacctacttaaaaggatggcatcagaaatagatgtctagaccacttctaagtttgaaccatgtagctgtggtgaatcctttctgatgctgagctttaatccctgtacagttctgggtttaagcaccaggtttaagtcatgtcatttggatagttcattatgtgattgagctcttctggaagttaatgcggaaaataaatttaaacaccatttttttttctgtttattcagcaattccttagtcgcagtccccaaagaggtcaaatgttaaacttccttcttaccccttcctaatgtagtggatatacatcaacaagtcagaagtacagatgtatttcagtttatgcaacagatgctttctggggaatataaagcaaatttctgggtagtgaattctaattttcttctacataccattatgaaatcaggaggtgagattccttatcaacaagctgagttgactagtccaggaagttgtgctattgggactatatctttacctccttcccctctatccccaactactctttgaatttccgtttaccctgctaagtcttgtctctctgatctttactggcctttctacattttccttatgtctactgtattcatttctttttcaacaattacatattcatgctcaaacagtgctatcacggggaatgcaaagatgaaaaagacagtctgtactcctgaaacatatacagtccattaagaaagacaatagccatcagaagacaacatagatttaaagaaaattccaggggagtgtagaaggaaatgaacacttctgagggattcaggaagtgtaggtaagatatgcatttggtcttgcaggatgatgagatgtttgccagacaaaaagttggagaaaagttatctaggcagaagaaatatcatgtgtaaagacagaattgtgaaagaatatggaatattcagagaaaattgagaattttcatttagcttgtgcagaatgggaagtgatgggaaaaaagggaacttaacaccttgtattacaattctttgcttaggttcttttatcctttaattcatgttgggctcctcaaaggaagacatctttgtttagttcatattttttattcagctttctgcccagtgcttagctcataaaagatgctaaattaatgttatcttactgaattaaactctctgtctttcttcagagaagcataatttttctcttacctgcatagcctttgactttgaagtttctgttcctcatataaaggaagacatagaaaaattagcagattccttttgtttctttaagctatactatattttcgtctaccttgtcttgaagttattccttatgtgaataaatgtttatggcagctgatgagaatcaaaggtttatttagtcacttgtttattcatgcaacatatatttattaagcatcagatatattgtttgcatcatgttattctagaaagaagtaagctgttcatgatttggaggtgtaataatatttcaagctattaagctataatttagtatgctttaatagagagcaaagatattaactgaaagagtaaaaatgtaaataaaaatatatatatagcttaacgtatggtccttaatttgtgttctgacaatacactttttattaggaactgtaaataaatcatttatgacaggataagaacagttttcatttcatttttcatgtacttataatttcaggcattttgcatgaaagatttgatgtttgcaattgctgggatttgtttctttgcaacataattgcttggttcattcatcttaaaataatttattttccaaaaaaattcattaaagcaagccttttaggactcactcatatttataaagcaatgtattataaagctaaaaaggtgctacacgatgcattcaaattaagaactctgaataaaatggcattgacattgtaaaatctgttgttgccaatattaagtatttctagttaagtggttagtgaaaatttgccactagtgaggatatagctgaccttatttttctaaaatgttaaatacatttctttatttctttcaaatgcttttgcatgcatatgattgaaagagaaggctgatatgaacttagcataaattcattaagacttaaatggctgtgttgaatcagttctaagtcattactggttctggcacatggtaatggccaagtatatgaacaaataagtaacatatatgacaaacacagcagctaagtacatttcatgtataagtttttgttttcttgaggtagtcctttttatactaatagtaataccaagttttgctatgcatatccaataaaaagcaaatctgtggtgaataaacctgcatttttaaaaagttgaggcagtgccctccgtacccctggcctaacacaaaaggtgcttgatatacttgtcagttctttaaatggtaggtaagggtgtgtgatttactggtgacttaccatgtcacaacaaaccatccacttacatgaaagaaatagccagaaggtatctgtattggtagtaattgagaattgtaattataaaaattaacctgaggctgggcatggtggcatgcctgtaattccagcactttgggagcctgaggagggcagatcacttgagcctaggagttcaagaccagcctgggcaatgtagcaagaccacatctctacaaaaaatttaaaaattagccaggtgtgctggcatacacctgtagtaccaggtacttagaaggctgaggtggaaggatcgcttgaacccaggaagtccaggctgcagtgagctgtgataatgccactgcactccatcctgggtgacagaacgagaccctgtatcaaaaaaataaaataaaataaattttaaaaattaaaaagttaacttgagagatcaattaatctcttttgttaaaatagtagcacataaatctggttacatacagatgagcttcttacctattatactcttctaaatttttaaaacatgtttttagattatcagtgtagttatgttcattaactagagcaagttttaacaatttccttccccatcctctgctacatatcttttaaagattcttttttcctctgcatttctctgtcctctacatttttcacctctattctgcgtaatatatttttaggaggtttccaagttagaacctctgagagtatccttccaggttttgtccggatgattattatattccctaattcttgagtcatatgaaaaataataattttagtttcttaaattttgaagactctggaatatttttactttgcctttggatttttacttataagaagattaatattattttacctttcctaataaatcatttgagatgctagtgttatatagagataaacaatttaaaataatcttttatggaggctaatagctacagagtgaaatatcagttaccaagttgagtaggtttctcgctaataaattgttataatttgaacttctctaagagattactataatttgttggcaaacaaatgttttcttattaaactcatttatacacaaaaatgaaaaatacaatcattttttactttagaaaaatgctttaacacagggaaaacttctgaaaatactttgcttttcagtattttcatttacaattacatttacagaagaaatatcatttacagttagtttgtatagttataaattgttcttatctagtcattagagagcatcttttataaacataagaggatttctttcatactgtagtgaccggctggacaaactctcccacatttcacaaataatccattcttaaatgcaatagaatttgaatagaatgttgttttatttgcccaagcaaatcttttaacatgagagaagaatattacagttcaaattaagcagtgaatatttaacatattaatactatgttattttagaaaacaaatttataactttagaagaaagtgttcttttaataaatatgtaaattcccagcaaaagacaagcagacttttatcacgattaaatctgtagtggtaacatacataacttggtatttaatgtttaggcatcaaaaccttcctctcccctcattttgtctccactaagttttctcttgtcttaaattgtcataggaaaaaaagacacctaaatgttatatacaaagtaggtacccagtgattgttgacttaataacatagcttaattcattgtatggcttactttcctttttcacccttcatcttccactttgacttaattattgttaccatgtttctgagaataggagtagaatattggtgctaaggaatgtggtagacatatccgctcacagatggcctggtgacttgtagttccattctgaactctgtctagtccaagtacagagttttttaagcaaactgttaaaaaagaaatcttcccatacctcagtttccccaactgtgaaaaggtaagtcaaacttagcctcccaggcccaagcaaattcttacattctttgggttttgccattttaagtaaggtggtaataactttaactttacacacaacagtaatgtgcatgctgctaagtgttttaatcaaggttatccttggataatattaaccagcctttttaaggggtgttttacaacacacaattagctgctttacattttaattgtaacttttgaaaactttccccaaagtttgaagggatcctacaatctttttctatttgaagatagtaaaaaggcttattacacttattcatataacccgtttctgctataaagtataatagataagatatttaggatgaattaacaaatattagttgaaatgtgagaacaaagaaaagaagaaaacaaatacacttaccaaaaagtcactgtgattgcttttggtgtgcttcatatttagttgtgagctaatacagccaggacaaaaacaaaaataattttagtttcataatttgtattacaaaaaggagaaagtatattagttcccctgaggaagcagagtttttcctgataccatattataaaagaaacttcttatacatcattatgtagagtacgtatttttttatctgatttatttacctgatttatttcttgctttttcattttattattgttggttgtgtttattttcctaactttggggaagcagaattatccctagtacctacattcctgaccatgtgtattgttaatagaatatctactcaaaaataattgttgataataattaatttcacaagtaaataaacttaggttttggttttaaaaaacaaatttattatttcttacaatcttgctttcttgggtagcatagttctaagatacaatgcccttatctttccatgttcatattagtacttaacacattttattataatttctttatatgacatcttcccaaatagtcacttaactgtgggctccgctaggtcaggaatcctatcttattcatttgtaactcgaatgctaccccattgcctgtgcataataaagtattcagtaaatattttcatgaatgaataaaactgactttaaatatattctctctcttttttataattcagaattatggcttggaaacagaaaatctaaaaaccctttctcacaagttgaatgcatctgccaaaaatctgcagaattttataacaggaaggagaaggagtggccattatgatgggaggaccagccgaaaattgccaaacgactttctgacctcagttgtggatctgattggagcagccaagagtctgcttgcctggttggacaggtaaagtcttccgcatgtttcataagtatcctctcctcagacaccagtttgaatataacattattttgcattttgttgtgaaaggattggacaggcagaggagtaccaagtaataaatgtctaatgatgatttaccacaatataggggtattaaatagatattagtcttttataaaatttgatgtccaactaagtagccaatcaataattagtctgacaactgtaaaataccttgctgctttataagcaaaatcattatttggctgtcataataaaatttataaatttttgtttattataatactgctttgtgtcctgatgttctttattcatattaattggttgtacttaaggaaatgaccattgggattctataaactgttttaaataggtaattagacactgacaccttcatagcatgccttgtatgtctccttggcctcgcttcattcattctctgttattaattacattgtactattttggatatcataaacacacttttagacttttttaagtttagttgactttcatttgttttggaacacataaaatagtataaaagtcttgtaatatgaaatgaaaatgttagatttaaattatatactgtatgtggttaaacattatcatgataaaacacattacaactgtttattaaaaaactaaacaaattctctactttcagttttggaatttttggtaaggggtatgtactatgtttaatggcttaataatcaaattttaaaaatgctctttgtctttcataagaaactctgataatatacattaccagaattctttcttgaataattgtcagtaggatattcatatgtgttcctacacacacacacacacacacacacacacacacacacacacacgccagtattacattttggcattttaaaaacatgaggccttatattaaaagtaaagcttttgtatttttaaggtgaaaattgagataattttccttaattttatattgtctaattttatatatacttatacataatataaagtgatgatactaaatccaaatatgaaacactaaactatatattactagctttttgataattaattaatggactacatgtttattttgcattataacattattaaaatttaattttcataattgtctaagccacattatcaagtgtttaaattaattgaattttaaatatatacattccaaaagttatgaatggtcagtaagtaaaatatggcttagtccttaagtactattaatataatacatttgttttggtaggctttacagtaatcagaaggcttaaagaacacatccttgattataattgtatcttcttttactctcattttccctataattataaatttgctcagccttgatatctgcatttagtaaattcatttatatattttttaccctagtatttgttagatggatagataaactgttagagtgaatagaaaatgtttttacttcttgatgacagatatggctatttataaaatcgcacatttcccacactatagtagtccttgagattttatcgtatcaattttttatggtggtattactttcattatgtaataaaatgcttttggtaagtgccaaatcacctacaaaacacatatgtgcatgcacacctacaaaagcacataaaaacacacccagtgtgtcagtgcagatttgctttaatttgagggatttaaaatgaaccctgcaaatgaatactgccaagcatttgatctttaactttagtttattccttcaatatacaatactttagatgaagaataaaaattttgtcagttaaataggattaatttgatgttataagcacctgttttcatttttaaacagctataagttttatggcattacaaaatttttattacattttggagaaaacgtgtatccacagcaatatgttttgggtttattacagtttttattttatgtcacttgaaagaggagaaagaaaaagaaagaataggttaaaaaaaatctttaattttattctagatgctgaactagatgctttatacataagtatatatactctcagctcattgaattctcacagagcagatattgttatctccattttacatatgaaatgtgaaataacttgcctaaagtcattcatctagtatgaaagttatactttgaatttatttttgtctgacattgaagtcctgttattttttccttcatgttcctttatcatgctacacctcgttttgaatgctgactaattcttgaggattttgaggaagggatatggcatataaacctttatttacattttgctatttctcttcaaaagctaaataagactaccacttttctgttttgggcctcagtatctgaaattgctacatagaacttcatttatagaaaatgtttatttcactgtttatggtaaaagtttactattttctctcatttttaacattaatatttaattctaattgtttctaaaatacctttcaagattattctattttaaagggatcattgaaatatttttgataacattgcaaaacctttaaatgtttagggcgtaatagtgtgctaggaaaataatatttatgactcacaaaaactccagtttcaatggagcttccatttaaatgagatacacgttcaaagaccagctccttacatttcctaaataagataaaatctaaggttaacacaattccattttttctcctatttaaaatattgatttcagtgaaacaccagactttcccagaggaatagtctcagaggtgaatcacagttggtagctttactgtttattttcaatgcatggtttacttgtctgtttttaacctacatcctactgtttttgacacctcatatttcttgcagttttctgtggctttgccaaatcgatctatactcagaagtttacagatcactacaagtgttacgttgtacagtaacattagtaaaaatgttcaaaattattattaaacaaagtttattttgcctttcatagtaaaagtttttttccttcatttttaccagtaatacccaattctgagagtttataaaatacctttttaaggtcatcctgttttgatgggatcagtgagatctcttgatatcattgaaaaccttttacatatttaaggcataagagtttaaggtactagggaatttttgttaagatttctctgaaattttttgtcttatgtaagaaaattgttaaactaatttcttcttccatgataagaaactaaaggacaaattaattttataccaggaaaaatattacagagaccaagaaaaccacatcaaacgctaccagataatgtgatccattgtttggtcttattttctctcatgtgctcattgtttctcacttagcactaattattcaagggaagagcagtgacattagcactaccattattcacagactaccctaaggtttcagcagtgccaacctgagaaatagtaaggcattccagattttccttattaacctcttagctttccttattagtttctaatttgtttaggatttctgaatcgttaataacctttttataaatgtaatacttttgtttagatataatgtacaaagaataatttcttatagggtcttaaacttttgcaccagagagaaatataagcatcgtattatctatatgatgatttaaggagtacagtcgcttaatttttaagatttaaataggataattcctgtaacagccacttatcgatgatccaaggattttatctttttttctctttctggcatcaaaaagctttcttgctatgaatttaatttcctttaattagagttattgtgttcttcttgtaagtaccctgaactctacttgaggatttcttcagacttaagaacagtttctttatttttgtttttgtttttgtgtgtgtgtgtatgtgcatgcatgctgatcatgttcagttattctacagagatctatcgtttttactctcatagatgatcattaagtcatgactgagtgataatctttggtaacccacaaagattggagccccacctgaccttttacccttatttatatgtagatacagcccaaatcatcataccaaaccttaaaatctgctggctaagaatggctgttagtacagttgtatatgatttgcctctaagataaaaactttagggtaattctaaatcactacaaaataaaatctgttttccttggtatgtgtttagatttttcttttcattttttcttgaaatttaatcttgagtgaaaagcttgtcctacttaaaatatgaatggtcaggaaagtggaagacatgccttggaattcagtttgctataggcatttagtgatcaaatagattttttcttttctatatttgaacatcaagtgagattcttttaagtagttatggtaaaacaaaacaaaacaaaacaaacatgctgtgcatcacctcatcacttcttaatgaaattttaagattttataaacagactctgaccttttcaaacctaggaatcgaaactcttttctaatcatgccagaagcacttttgaattcttagtttaaaatgccagtttttatgcttcaatgcagcaaaaatggtctctatgtagttttttttttttttttttttgagacagtctcactctgtcgcccagcctagagtgcagtggcgtgatctcggctcactgcaacctctgctgcccaggttcaagcgattctcctgcctcagtctcctgagtagctgggattacaggcacccgtcaccatgcctagctaatttttgtatttttagaagagacggggtttcaccatcttggccaggctggtcttgaactcctgacctcgtgatccacctgcctcggcctcccaaagtaatttttttaaattaatgatattctcctagaagtgcttatatttttcattaaaaatatttttattgaggcctaatttatattctataaattaacctattttaagtatacagtttgatgggttttagtaaattttgataacacctaatacaaccacctttacaatccagtgttagaaaacttccatcaggatggatttttaacagttggtttctgcttacaactaaagaggttaattttttttaactgacaattttgattaatcacatttttttctaattcagttttttaaattcttatgtctccttttatttaagtaaattatcttgaaaaaatatactgggtttaggagtaggaatagataagttcatgaaagagagcctataatacactgtggtgtagtcatgcattgctaatgataaggattggcaattttgttgttgtgcaaacatcatagagtgtgcttacataacctagatgatacagcctactacacacctaaactatatggtatagcctgttgctcctaggctagaaacctgtacagcatgtgactgtactgaatactataggcaattgtaacagaatggtaagtatttgttccatatctaaacccagaaaaggtacagtaagaatacagtattataatcttatgggaccattgtggtatatgcggtctgttgttgaccaaaacgtcattttatgcagcacatgaccgtatatagaatcatttagaaaacaatatgttaaaaccactagaaaaagaaagggccatttaataaattgtagtggggcgcttggttaagcctttggaaaataaataatgatagagcactatctatttttcttcactaaaataaattttagatatatcagatatctaagaagaaaatataaatttacaagaaaactagaaaaaatataggcaaaaatgatttctagatgtggaaagactttctaagtatttttaaaatggaataaaatacaaaggaatgtactgttgactacataaaaaagaaaaacgtaataaagtataagacagaagacaagctgggaaaaatatttgcaacaaacagatatgaaaagcagagggttaatgtgtaatgtgtaatattcatatattaacatatgtgaatattcatattgataaaaaacaaagcccaccaaaacgtaacagatgagtatataagtaggtaaatcaaaaaagaagaaacagaaatcactggtaaaatgtgtatatcaaacaacagagctttaaagtgcatgagcaaaaactgacagaatgaaagaggaagtagacaaatccacagttgtagacttcatttcctctttctcaagaatagataaaattaaacagaaagtaagattagaagagctgagcaccaccacctaagaacaggatgttttgacatttttagagcacttcatccaacaacaggagaataaaaattcttttcaagtacccattgaacattcaccaagatagaccatatctgtatcataaaacaaaattcaacaagtttaaaagaattgaaatcagataataaaatgaaactggtaactcatacagcacacttataagtaatccaacggtcaagtctcatggaaaataaaaagtaatacattgaacagaatgaaaaaagaccaaatcataatttgtggcacacagctaaagcagtgctgaaaaggaagtgtatagcactgaatgcttatatatatcagaaatatatatattcaaaatatatcagaaatatatatagtaaatatatcagaagcactgaatgctttatatcagaaaagatctcaaatcaatcatttaagttcccatctcaagaaaatagaaaaataagaacaaaataagtacggagcaataagatcctcttaatgataagagcagaaattagcaaaattgaaaacaatagagaagtcaatcaaaatgtaaaggttaatgaacaaatattacagataacttcacatataaatttggcagctcagatgaaatggtccaattccttgagaaacggtactaaaacaacccaaaatgaaatagatactctgaataatcccataactattgaagaaagtgaatattacctagaaacgcctcagggtgtggaaaaaatctgcaggctcaaatgatttcattgttgaattttatatatttgaagaagaaacaccatttctataccatctcttccggaaaataaaggcaggaacttttcctatatcattttttgaggcaatcattatcctgatatacccctcccccccaaaaaaaaactacagaccaatatttctcaggaacttagatgttaaaaccttcaacaaaatattaccaaactaaatctaaacgtgtaaaaagaattagacacatgactaaatgagttgcttcaaacacttgaagatacatcagtatacaggtccaccatttactagttgtgtgaccttagataagtcacttaatctttctctaccttatgcttctcctctgtaaaatgagaataataatagtgcctatctcataatagttgtgaagattaaattacctgatacaggtaaagcatttagaatagtaactggcacatagtgagccctcagtaaaccttagcagttgttattactagctcttgattgtgaatattctaagtagatactgtactcagaatcttagattcttttgaaaataaactgacatgttatctttgcctaaagtattccttttttgttttagatgtagtgaagataccttgtaagaaccaaagaacttaaataattaagaactttaaaaagagagaaatttggtagaaagcaaacattatatttcctgaatttaattttcttccaatcatttctttcaaatctttccttaaaataagtcctgaatatttttatcagtatggaaatttcagaacaatttatttcatattattgataaactcattttaggctactatattttgggacttttcaaaagctgttactagtaatcacaattttccttttccctttataggtcaccatttgctgctgtgacagactattcagttacaagaaataatgtcatacaactctgcctggagttaacaacaattgtgcaacaggtattagctgacaaactttccttctgttaatttattagcaacttcatattccaacaatgggaagtatcctatgtaccaagagtttttaagatactggtttagaagtttctcaaagacaaaccattctaaagaaatgaaatgtgtagttatttattgggagactgtgcatttagctcagttagcttaccagaagatataaaaggaacctgacctgtacacacacaaacaaatgtgcctaatagcttttaacagtgatctaattacctgaactgattttccacttcaaatattatctaagccagggatccccaaaccagatgccttcagggtccagcagctaatataaatgtttaaattaagtccggtataaggcaaggagaaatggaagagacttgggtgaattgactggaacatatcccatatccaaacatatcttttagaggaaatgtaattataggcatgatatattagtgcttgtaaattatctcttaaataatctgttctttttctactgttatgtgatgatatctcttttcagtaccaagtttttctgggctctgtggtctcttgctaccagtagtagcaagaagaataaggattaataggtaaaataatgaaataaaatagttaagtgtttatttctttatggtgaaactatgggtgattttatttagactcgacttttctctattttccaaatgaatttttattttctaaaatgaatttgagttatcaaaaaacaaaaaagaatgttaagtacattgaagaaatacctctttaagtttgccaaaggaacacagcttagacaaatactgaaattatactttaaaataaattacatagcttacgaacagttaatgttcatctaatcatctaattcagccattatatacatactaatcactgcatttgattggaattgtatgaagtatctgaagacaggaattaaacttaagctgccagtaaaagaggccaatttgaataagcaaggtgtagacttttaaaaaaatctaggacatgcatttattaccaggctttcaagaaatctcttctgaacagttatgatgatgattatgctttgaaatatgctgtgcttcaaattatttttcattcagctttaattatttttattccctttgcagcaagatgagataatcaatatctaaaaataaactgtcacaaatggcttttttccccttcctaaaacaaagtggtgctactatgaagtaaaaggaaagtgcttcttgatattggccacttacatttaaaataatactaaaattagaggagaaagttaatgtcagtttcttttgaaaacctccatttgcaggaatttgtttaatctgctatatttattttacttattcccagttgtgatgggtttggatcattgtatttgaagccttttaaagagatttccgcccccctccccaacactttcctcatcacataagattggttataatgacacttttgaaaaaaaaaaagagaaactggttttaaaatcttaaatagaattctcacaaagaactgaagcttcatttagaacactgacagcaactgaatcagaacaatgagacaggtacccacacactacttgtcagcctttaaataattgccatgatgccttccttaatggatatcagcttaacctaaaattattctactgtaccatttttatgttctccacttcaaacacaaaaatgatgaattagattgccactagttaagaaataagcacaaaagtgttggtttgcaagatgaaactttggtgaagcttaaaatacatggggcaaggttgtaatcttggaagatttgagactcagccctgtttttcatgatgattccacattggacaaacgatgtcattgttttcgccatctgtaaacagaaataatcacctctacctcaaagtttttctgagaaccaaatgagatttatttaaaaatagtgaagacttagaatcaacctaaatgcccatcagtagtagactagattaagaaaatgtatatatacaccatggaatactgtgcagctataaaaaagaatgagatcatgtcctttgcagcaacacagatggagcttggaggtcattatcttaagcaaacttaacacaggaacagaaaaccaaataccatatcttctcacttataagtgggagctaaacattgagtacacgtggacacaagggaacaacaggtactggggcctactcgagggtgaagggtgggaggagggtgaggatcgaaaaactacctttcgggtactatgctcattacgtatgtgataaaatctgtacagcaaaccccatgatacccaatttacttatataacaaacctgcacatgtacccctgaacctaaaataaaagttaaaaaaagtaaaataaaataaaatagctgatgagtgtaaagtgaaaaacaaagatgaaaataatattatttacaaaaatgggtaaggaataaagagacttgataaaaggaagtaaaataggaactttgttttgaaaaataaatgtcagagatttttttctccatttggtgttagttttcatgagctgcatttacagtgaaatctgaattaggtgctgagggaaaaattcaaacatgttaaagaacattttaaatcagattttgaagtgttaaatacagagtgaaaaattcctcttaaaactcaagttttgatgatatgctttttacctgaactggtcctctctaaactgtatttattaaaaatctctgcttgcttatgggtctgttcatttctaaccttcttagatccattttacatgttcttggttatcgctggttgtctgaatagtgttaaaaacattttacagaaaactgtaaggaagaatatttacaataatccaatcctaattacgcagaaacaattagtgctgttgctttggtctttcctgtaataaatgtctttacttaagttgttattctggctttctgacagttcttttgttttactttgttccatatttacctgtcagatgtattttattttctaaacctttgttcaagtaaatggacaaatattctttaaacatcagtattaaaaatttttatttttgatggacagcctcctttaaattatgtgctttctattcacttgtgttacctttatattattttaaatacagaaaataaaagtaaataatttatgaaacatcctctaaatctgcatcttaaaataaagatataaatgagcatattgagtatatagccctttttaaatgtattcctgctcaaatgtaatataaccattttatctgttttatcttaagttgttaattgctcaaggtaaatacttgagaagataagagtttttaggacttattgaattgggatttgtgttttaactgcttagagcacaaatttgtaaatactgtttagaaagattataaaattttgttaaaatgaatagcccagaagtaatttttagtttcattaaggatttattcaaggaaatttagcctgtagatttattgattatagatattatattttacttaattacattcatgtatatgaatagtacttcatttaccttcttagttgacatttcatatcatttactttcacaatttatggcaaaatagtgtagtgggcactgacatgaagtagatccaagttcatcatcctggctttgcttttcaacaaacagtataaacttggacaaattacttcatatctctgatattatttttctttttctgtaaaagtggatccctaccattttttagattattgttgggctgttgtgaagattagaaactgatttagcccaccatctggcatatagtgggagcttaataaatggccactcgagttattttgtgtagcaaaagagcctttggaaatgctaaactcagctagtttctcgctccacagaaaatttcaaggagtgatgctctgcttacttttggtattgagtggcaatgaagaaagatctcatttctaaaatgtgatttaaaaaaaaaaaaaaggattttagtataattcagaatgttctttagattttaatgcaaatttattactgtgcttcattttctgcaagatatgttgaaacattcatgttcaaatgtaatacagaaattaattttgattacccaggaatgtatcatctctattcacatattcaagttcaagtagtaaatacacgtaaagatgtaaaatggggatataaattatgctggagtaggcaaggtacgtattctatcgttcatatggtaagtgttgaaagcatatgaaaagcctgtccagaatggtctcacagacatttaaaacacaactttaaatattacttttactatgtactcagagttagtgtttaaaccttcctgaatcagacattctgggtgacctgaaaattatattggggctcttgagattgaaactgggacatttcagaccaaaaaacaggacaagctttatatgcatttttaaaacaatatggattatattagcatactcaattaaggcaatataaaaggtgaatgttttttcacttttttcttttatttttagttgacacataattgtatatatttatggagtacagagtcatatttcagtacatgtatacagtctgtaatgatcaaatcagggtagttagcatatccgtcatctcaaatatttgtcacttctttagggtgggaacattcaaaatcctcttttccagctttttgaaaatatgcaataaattattggtaattatattcattctacagtgctatagaacactaggattttttcctcccgtctagctgtaattttgtatctattaactaatctctccctatcccctcctctctcctacccttcccaacctctaataaccacaatctactctctacttctatgagctcaatttttttagctttcgcatatgagtgaaaacatgtaatatttatctttctgtgcttgacttatttcacttaacataatatcctttagactcatccatgttgctgtgaattataggatttaattctttttatggctgaatagtattccattgtgtacatataccacgttttcttcatctattcatctgttgattaacatttaggtggattccttatcttggctgttatgaatagtgctgtagtaaacatagagatgctgatatctcttggacataccgatttcctttccattggataaatacctagtagtgggattgctggatcatatgatagttctatttttgtgaaatatacattctgttttccataatggcactacaaatttacattcataccaacagtattttttcatttcctttctgtttaaacaaataatacttttaattcagttcaattatactttatcctttaatttttcttcagccttttactttaattataaagaagcaatatcttttcaaattttccgtataatgctaatatagtaagtcagaagttagatataaaactatcagaaataatacccagataacttgaatactttttttctgaaaaaaaatgtaaaaactaaaaatatattgttttcaaaactgaaggaatgttatatatgtgcacctgtatcttctcaaaggtgtgtgtatgagaatattatcaaaatagatataaatacacatacaagaaattctcattcatgatattaaatacctaatttttggcagctgcatatttctgaaggctcagaatgaagagataagagtgatgacatcattgcatactaatacttagcaaaggactctagaagagtggggcataataacttattattcctgcagctttctgatactggcctggcttgtgagcaaaaacttaaagacttactgtgtatcatattaatatggatgctgaaatagattgttttcataggtttattcttttataaaccaaaactatattgcatgttatcagagtcgccctgccaaagcgcttttaaagatattatcaccatcaataatatcagaaggagaatagatgagggtgtactaaactcatcaattccttttagatagcaaatagtagatcctatttctcagacatcttctttcttcactgtattacattttgaaatttatgaaatgtacatacatgcaaaagaatgcatatatgtatgttatgaagaataataataaatactcatgaatctgccctctaattaaataactacagcattaccaatattgtttcagttacttttgagctcctctcccatttcatcagcttgcctcctcaaggtgtttatcattttatttgttcttaaaatagtttcagatacttctctaaatgtatcatttgattatgcttgtctttgagcttgtaacaatgctgtcactctgtttcttactgttttcaatttatgtatttctgaattcatgcatgttttcctctgtagctgtagttcattcattttcactgcatataatattgaattctgtgcattatgtgcataccccaatatgattatccattcttcttatcatggacatttgggtatatacctacatttaagtgtaattactaggagtgtaattactaggctatacagtttgcatatgctcatctttacagctgtgaatatcatgttctcaaaattttattgcttattatgtcttgtactttcattatctttctactatctgaattactgtatttgagtcctattatgcagttcacctttgaagaggcttttatagttttctcacaaagaccctaagaagaggtaacttttacctttattcctatactacatatagggatacagatgtagaaaggtgggttaggctatttttgatcctcatgagtgataaaataaacttcagaggagagtccctgatatgctaccatttgtgatatactgtgactattctttttaaagaaccaagccaacagtaatagttcatttaagaaaagatttgctgtgacagacttggaagcaggagtagtccccatgctcttctgtgtctccagtgcctggcaaataagtgtttgttgaaagaatgatgtaattatttttcccttaaaagttcaccaaaaatgattacagaaatttagaaactttaggagtttagaatcaagtaaagagctgtttcaaagcactgatgcctgaaccccatactggacccattaaattagactctttgtgatggggtttggcatcagtattatagaagtgatgcctcaagtgattcaaatacgaagccaaagttgatagcaattgtgctatactcatactttagaaggagacaaatatgaggtgggaaaaaatgcatgtaattaagaacagtgtttcccaaaggaaacactggaccatgtttccatggaccatgattcatctaaggaggcatactaaaaatgcagattctttagactttaccacaggctgaatgattgagaagtgtggatcaggaggttcaattatttataggtgataacagcccagagcctatacatttataaaggagtctggttagttttcaatttataactgtagttattagtgggttatagtccctctgtagtaaatacatatccaaaaggattaggcgtgttctatgaaacatcaaatataagttattaaataaaaagtggttattgcacacttgtaataagaaagagagaaccaatgctagaaagtggtgtggtggtagtagacaggggaaggcactaaggttagtaaaacaagaagcaataataatcattagtaatgttttaagcatttattatatcatattgtaccatacatgaattacatgacatagattttcatacctacacaagatgaaagcagcaaaccaaataaattatagttactattaggttggtgcaaaagtaatcatagtttttgccattacttttaatgcttattatgtcttgtactttcattatcttcctcctctctgaattaccatttttgtcatatgtcataatattaatattacttttaatggcaaaaaacacgaatacttttgcaccaacctaatagttataggcactgatttattaaggcatttcgcttctgctgaagaagtagtttttaacatcccagtctgcttaggttgggtcagaatgaccaccaacatcagataggtaattcaaataaaattaggccctaacacaagtaaaataatggattgaaattgtaaatgacagcggcaggttgaagaactggtcagaatcaagtaattaggacaagtgagcacaaatcaaacttataaaataagtcaaaatttatctgttaaaaccagattgggccaggcgcgttggctcatgcctgtaatcccagcactttgggaggccagggcgggcagatcacctgaggtcaggagtcaagatcagcctggccaacatggtgaaaccctgtctctactaaaattacaaaaattagccaggcatggtggttcatgcctgtaatctcagctactcagtacactgaggcaggagaatcacttgaacccaggaggcggaggttgcagcgagccgagatcacaccactgcactccagcctgggcagcagagtgagactccgtctcaaaaaaaaaaaaaaaaaaagccagattggaaaagactagatttgcaaggaggtagcagaatgtaaccttaggttgactgtgggtaacagtatgtgaggcttgacatagcaccgctaaaaaaaaacactaataacccatgaaatgaagagatacagcctggaaaattaacgaaatggttattgcattaaaatctgcattggttaggtcttcatatgcacatctgtcttatgtttcccttctattggtgcagagttgtattagtcaaggtatactagattatgctgcagtgacaaacaacctgaaaatattagtggcttttaataatgctcatatcaaatgcccatgctccatgtgcatcctgggttgctatagctttactctatgtcctattcacttcaaagcccaggctgatagagtagtctcttctagaaaattgctggtcatcatggcagaggaaaaagagaacatggtgaaccatgcattggctcttaaagcttctgcataaaaatgagacctaacacatctactcacaattcactggtcaaaacaagtcatatagccatgactgacttcaatggctcaaggaagtttacttttccctttaaaaaatggcaggtatatatttggaaatcataatacagtctgccacagcaatcaatctatgaagaattccagtataacattatactagaattttgaggacaacaatattttttatttgaatgtaacctctctctcctcaatactgaagtgtgtttgtactgtgtgtgtgtgtgtgtgtgagacacagagagaaagaggatcagtcggtattttaagtgtaatctgctggaatatgactggtaggtttcagtgggggacaataaatgaccttttggattttgtccaagcacaaaattctggttaataatcacttggtactcggcgttagtactaggaaacttaaacagatatggattctatggaatatctcttttcaaggtgtaccaaattaagcctagatttaagatagtactattacttggacaatttagtatttattaggatttttatatcttgtcatcatcaatgatctaaaactattttttgcatacgcggacataactggcgctttttcaaatactgcacacaattactgaaaagaaatgattccattttttacaagaaaatgcaatctaaatagataaaagagacaaacgtatagggcctgaggaattgtttaaactgacagtagaaattatataccataccatctctattttatgacagccaagtgaataatcttgaattaaagaattaatgttgaatttatatttttatttatgatagtatttgattttagttttgctttgcaccctttatttgagtttattacaagggaaaaaatgcctcccattgcttagaccctatagagtttcctttccttgggatatagtagatggtcattaccataagcaacttgaatatctggaagctagagagactttctattacaaagaaatgttagcctcattctatgactataaagttcttgctatcttttctgtaatacaaatcttgcagtaaaggctcaactatttttgttaaatatatcttctgagatcaagcagattgaagtttaaaaccaaactcacatacaaaatgttttaaaaactgtgaaactcagtctatttttgtataaaatagaagtgtgaagaaactaagtgtactgtactagctttgcaattagaaattttattttcaacaatatggctttatgagttgcatttttatactcatatgtaaaatcaatgtgtaatatttattacagaaagtgaaaatagagaatcagtgcaataaaatattgataacagataaattcagattatagagtgtacagagaaccttgagaaagtaaagagacattgaagttgaatatggggttccttctctgaaaatattaacaatctaatgggaaagactaagactagcaaataaataactgatgaaaacataaaatatctagaactagaaataccatttgacccagccatcccattactgggtatatatccaaaggactataaatcatgctgctataaagacacatgcacacctatgtttattgcggcactattcacaatagcaaagacttggagccaacccaaatgcctaacaatgatagactggattaagaaaatgtggcacatatacaccatggaccactatgcagccataaaaaatgatgagttcatgtcctttgtagggacatggatgaaattggaaatcatcattctcagtaaactatcgcaaggacaaaaaaccaaacaccgcatgttctcactcataggtgggaattgaacagtgagaacacgtggacacaggaaggggaacatcacactctggggactgttgtggggtggggggaggggggagggatagcattaggagatatacctaatgctaaatgacgagttaatgggtgcagcacatcagcatggcacatgtatacgtatgtaactaacctgcacattgtgcacgtgtaccctaaaacttaaagtataataataataaaataaaataaaaagaaagcataaaatatgtaaagctagtagagttatctggtagaccattcaaaaccatttaggccttgtctcatgacatgcaaaataaacaaacttagttcataatgggaattaactcactgcctcttcaggctgtcaaaacacagctattaaagttacaagacagctattaaagttacagggattacagtctcaatctaatgaatgaatgaatgaatgcatgaatttatttattttccccaagatggagtctcactctgtcacccaggctggagtgcagtggcgcaatctcggctcactgcaaccttcacctcccaggttcaagcaattctcctgcctcagcctcccaagtagctgggattacaggggtgcgccaccatgctcggctaattttttgtgtgtttttagtagagacggagtttcaccatgttgaccaggttggtctcgaactcctgacctcatgatctgcctgcgtaggcctcccaaagtagtgggattacaggcatgagccaccatgcctggcccactctaaatgaattttctaatcgttgataaccttgacatttttacttcagtcttgaaattttgatttttttggtttgttaaagacccatatgaatgctgaaaaaacaattagcctttcttttgcctgtaccctcacgtctctatatgctaaaaaattattttacacactcattcaattattggggcgttagtttttcattgtgaagtaaaagactagagtagttggagctaactttagatgaccttgtgggagagaactggaatagaattttgtagaggaatattatgcaagatgtggaagaattggccgtgttcactgacagaagaacaaagtagttctcagccattttacaagcatgacttattttattttattttattttattttattttattttattttattttattttattttattttattttgcagaccccatgtgttaaaaaaaatttaaggcttttgaactacatttctataataataataatttccctaatttttaattaatgatgtgtaaccactagtcagcaggagacaaccagtgttaccaaagtcagtttgtgcaatatatggtttctcttgccctttttgaattacccatagtggttctcaggccacactcctccagagttatctctatatactatcctggaaaatatgagtaataatatcttcatcttttattttataatttggaaaaaattaaatgacagaaagaaatggagaataatgtaagaagcagacatggaccaacacttcaaattgataaatattaagatatggtcatatttgcatcagaacttttttataaagttgtttgtatttctgctcaggccccttcctcagaggcatgcatgagcattggcatgtatccttttggttgatatttatatactttgctatacatatatgcagaaacaatatattttacttctcaattttagtcaacaatgaaacatcatggagtttaaacagaaggatgtgggattatgataggataattaaagtggttcagaagtttgatatagtagtcatatcagaccctgcttgaaactccttgatggcttgctcattagcctcaggataaaactcatattatttaacagactttcaaggcaacacattattagatttccaaagttttccctcttcagttcatctctccatatttctctttcatatctcatgcccttgttgctctgtatgcctcagccataggaccttttaagtttttaaaattttcagtctctaaagctgtattagtccattcttgcataggtttaaagagctacctgagtctgggtaatttataaagaaaagaggtttaattgactcaaagttctgcaggctgtacaggaagcatggctgggagacctcaggaaactcacaatcatggcagaaggtgaaagggaagcaggcacatcttacatggccagagaaggacaaagagagagcaagggggaggtactacatacctttcaacaaccagatctcgtgagaactcactcactatcacaagaacagcaagggggaaacacacctccatgatttaatcacatcccaccaggcacctcctccaacactggggatcacaatttgacatgagttttgggtggggacacaagtccaaaccatatccaaagcctttccacatatttgttttgcccagtacaattcttccaactttagttcctctcatccttccaacctcaatttacacatcacttcctctgggaagttcctctgatccttccaaaatatgacaccagagcccaattaagacattttagaagcctcaaatactaaaagtcatataggttatatgactgttgccctaccaccatattattcacaataaacacaatattaagtgcaatgaagtctgaaatttcggtttcctaatagtgactattttgatgattttattctttgaggtattgagtatcatgttatttgacaaaatcaagttacttgtttgcttactgcacagcagtctgttcttaacccatcatggtgcttattaaataatcttattgtttttctgcacattttactagactgtaaacaatttgacggtaggaattatgtattgttcaacatcctatccccagaacaaggacaatgcctggaacatggatattgatcaataaatatttgttaaatgaaaaaatcaatgttaacctagtttctcatggtttacaattacttattcaaaagccttgccttctctaagtttattcttagagatgagcaattccgacctaaaaggacgtgaagatcaagttattcctgtgtgtcgcactcactgtataacagagtggatcttcagatgagggaaaacatgaatataaactatgtctaaaggtacatctgtttgtataatattttacaatttatgaagtattttcaaatataccatctcatttggtctttataatacacttgggaggcagatatttttgtctaagtttcagatataaggtagcaggctgggacaggttaaatgacctgcaaagttatgtggcagtaaggcaggactagaactcaagtccacatcttttgactctaaataacctctctatatggaaacctgtggatcagtttatctatggctatagagcaatatagttctttctgtcactgaaaattcctaacctgaatgcttattcatgatgatcaaagtaaagcaatagtgcaattagaatatatcttccaactgactggtaaatcaatggattttatatttcaaaggaaaaaaagtaatcttagtatttttctctcttacatatcttctagagcctttacaaacctgagagtgtctatatactcattcttactactttctgagtttttggcatcgataatgttctaggtttttatagtgagataaaagtgttaaagtattggatttgagtctcagaaaacatgaaaatccaactatttttattttattattaaacaaacatattaatgattttatgtgacatttttgcataaagcttctacagagtcttctttctatggtttcagtatgtaaccaataagtcatttttatgtaaagatgtttgctttacccaagagattgtaaatgaaacttttatacccaaagccattctgtaatgaagattaccttatgtaacagattgaatgaaagcaagtcagaaataaatctttgtagaaaaccttattgacaaaattctccctcattcttttttaatccccttaaatcatattgccaccagagagattgatgtcagtggcatatttgatcataacactcttctgcttataccccttcaggggtacccccttagtgtacaagataaattttaagttctttcaaaatggtcaagtaccagcctatttcatcagcctcatttcacttcttcttgctttacaattcatattctagtaagaacaaactatgtttagctccctgcataaatctggttctcagccctatgcctttttaatcatgctattccccttgtcttgactattcctcagcttttatctggataactcctgtttattcctccagattctactcatgcttctctttaaaataaatgcctttctcagactgcttacctaggtggtagtctttccttccttaacaccctctactcatgtctttctttacagctactaatttatatttttccagctctattgaggtgtgattgacacattaaaattgtacatatttaagacatacaacatgatgctttgatgtatgtacacattatgaaataattaccacaaacaagctaattaacatattcatcacctcacatagtttcctgtgtatgtgtgtgtgtctctgtgaggtaagagcacttgaaatctactctcttagcaaatgtcaagcatgcaatacattattattgactactgtcaccatgctgtacattaggtctccagaactattcatcttatgactgaaagtttgtgccctttgaccattatctcctcccaccctgtccattgtaaccaccattctactctctgttactgtgagtttgacttcgttttttagatttcatatataaatgagatcacacagtatttgtctttctatgtctggcttatttcatttagcatgatgtcctcttggttcatccatgttgttgcaagtgggagaatatccttctttttaaaggaagattaatatttcattgtgtgtgtgtatgtgtgtatcacattttctgtatccattcatcttatgtagtacacttagattgtttctatatcttggctactgtgagtaatgctgcaatgggaaaccagacatcttttcaatatagtgattttatttcccttggatatatactcagaagtgggattgctggataatatagtcgttctatttttaatttttttgagaaacctccatactgttttccatagtgactgtaccaatttacgtttccaccaacagcagacaagaattctcttctctacgtttttgccattacttcttatcttttgacattttgattatagccattctaacaggagtgagatgatatctcattgtggttttgctttgcatttttctgataattagcaattttgaacattttttcatatacctaatggccatttgtatgttgtttttgggaaaatatctagtcaggtcctttgcccagtttttaatcaggttatttgtttctatttttgctgttgagttgtgtgggttccttacatattttggatattaaccccttattggatacatggtttgcaaatattttctcccattctgtaggttgccttttcattttgttgattctttcttttgctgtgcagaaactttttgggttgatgtagtcctgcttgtttatttttgcttttattgcctgtgactacaaatttatattgtactatatacacatttttgcgatttttctttcctgctaccctttgagctctttgcatcttctttccttgggaattttatttcggtatttttctacccttgtatcttttggatggtctgtgcatatttttctctagaccactaagtaaaataacatataacttggcataatctattggtaagaagtcaataatcaataaacaccatgccaagaatagaacatttcattattcttttgtagttaggtaagacgcattgatattttttgttaaacatcattgtatgatacatcatgatattgattaatgtattttagcgattcaagcacataacgcatttcaaaggtaatgataatctgtaaatgtgtgcagatacaagtataccagtgtatgtggtaggtggaaaattactacagttgtgggtatggagacactgcaagtacagaattatggaatcagggccttgttcacttggaaggaaacttaggagtcatcttaattcagctgcttttgaaatttgtgtgtggatcatgataataacagctaacatttgcatgttttgtaatttacaaaacatttccatatcacttgatgttcataggcagttcaacagagttgttattgttatgatgctcttgacaactctacaaagagaattggtttcattgtactgtgctgctattgtagatttcataatagactggaatctgctgtttgctgaaggaataagaagggatacatcttgttagtacaactgaatccctccatgttttcttccagatgtggcctttactgttatttgtttggaatttttgttaaatggcttcctgttttgtaactgttgggtggactgtagtatatttctctagacctgcactgcatctaacaccacagtaaccactagctgcatttggatattgaaatgtaaatttaaatcaattaaaattaagtaaattcgattcctcatttgcatgagccacatttcaagtgctcaataaccacgtgtttctaatggttatcaaattgaacagaatagacaaagaacatttttgttatcccagaaagttttattggacagtgctactctagaccattgctatatgtatgcatcttgatgaagttgtcatctgtcagtagttaagctgggatgctgtaaggcagaaatctgtaaaagtaatcagactgacaataagtggtaaatggatgaggattgttctagcttattactaaaaatggaatagtccctctcccctatggaaaagttgttagaaacttttttgaatgtaaaagactgtaaaatgacttaaaactagtgaaaaactgaagttttgctttcttttttaacttttaagatcagaggtacaagttaacatttgtcacatagtgtatgtgtcatgggggtttgttgtatagattatttcgtcacccgggtattaagcctagtacccattagttattttttctttttctctccctcttcccaccctccaccttccaataggccccagtttctgttattcccctctatgtgtccatgtgttctcatcatttagctcccacttaaagtaaaaacatgtggtatttggttttctgttcctgtgttagttttctttttacaaaataaattttgcttttgttgttcttcagctcattgtggccaatactatatcacagtatctttttcctctgaggaataagcagctcatgtcaacattttctactcctgacaatattcttcatcctttttttttttttttttttttgagacggaattttgctgttgtccaccaggctggagtgcagtgtcacaatctcagctcactgcaatgcccgcctcctgggttcaagtgattctcctgcctcagcctcccaagtagctgggattacaggtgtgcactaccaccacccggctactttttgtatttttggtagagacagggtttcaccatgttggccaagctggtctcgaacttctgacctcaagtgattcacccgcctcggcctcccagagtgctgggattacaggcgtgagccaccaagccaggctatccttaagcttcaccagatttgtgcctccttgcccctggttgataaatttgccacatttgttatactgttttaagaagatggaaagtattagatatattcttgattcatttatttttccctttaatatcacacttcagtcagctagtctcctttcttcatatttgtcatgtcaactcctccaatgatgcgttctgcttggtgtgtatatagtactagatcttccatctcctaatacactctcccaacaaaaatgacaagaatcatgttatatagagcatacttatatattctttgcatttataatctttacatcagctgagttatataaatatgtttatctggatttttgtaaattactgtatcatgataaatgctaaactgcctatcttctttttttcatcactttgaccctgcttctcaaaaaactatgcttatagttcctttcctactttgaaatatttcttagaagaccagtttatataagtactcttacttgtacatctaaactcctcacattgtctttttcaactactccatctccattattaaattaaaactgatttttaaagcttcttgctgtcatttttctctgactcttacttaaattagacactgtttttcccttctccctttccaaaactcttttcttgtctctgtaatatcactttcttcatttaatcctggccatgggattaattcttgctctggctcctaaacaagcattgtctgaggttttatcctcagccgtcttcccaccatacatactctgttctggtgaagtcatcattgttgttttcttgtagctttaactatcccttcaatgtcagtatcttcaagatctggctctgtttccattctaattcagttttatcaaatgcttgccagacaattgtatgtaacacgttctgttttcagccgcttctaattttatgtgcacaaaataaaattgttttaatctcctcgatttcctttctccatctctactataccattcatccatccatttcctcaggcttgaacacttagagtaatgtttaacttttccttctccattatttcttgtttattaatttgcatatttcaaattttttgtggatacgtagtaagcatatatattatggaatacatgagatgtttgatgcaggcatgcaatgtattcataatcacatcatggaaaatgaggtatgcatcccctcaagaatttatctttcatgctataatccaattatactttttaagttatttttaagtgtacaattaaattattattgactatagtcacactgttgtgctatcaaatactagatcttattaattgtttctaactgtatattttttgtacccatccccacttctcctccacccccactgctatatttcccagcctctggtaaccatctttctactctctatcttcataggctcaattattttgatttttagatcctgcaaatgagtgagaacctgcagtgcttgtctttaggtgcctggcctgtttcacttaacataatgatctctagatccatagatgctgttgcaaatgactgaatctcatttttaatggctgaatagtactccattgtactacattttctttatccatttatctgttggtagacacaggttgcttcaaaatcttggctattgtgaacagagctgcaaaaaacatgaaagtgcagatatctttttaatatcctgatttcctttccttgggtatatacccagaagttggattgctggattatgtcacagctgtatttttagttttttaaggaacctccaaactgtactccatcgtgattgtactaatatacattcccaccaacagcgtacaaggttcccttttctccacatcctcaccagcatttgttattgtctgtcttttggatataagccattttaactggggtgagatgctatgtcattttagttttgctttacatttttttgatgatcaatgatgttgaatacctttgcatatgcctgatggccatttgtatgtcttcttttgaaaactgtctattcaaatcttttgcccattttttaatcagattattagatttttttttctatagcattgtttgagctccttacagattctggttattaattgcttgtcagatgggtagtttgcaaatattttctcccatgttgtggcttgtctcttcactttgttgattgtttcctttgctgtacagaagctttttaacttgatgtgatcccatttgtccatttttgctttggttgcatgtgattgtggggtaatactcaagaaatctttcccaagaccaatgtcatggagagtttccacaatgtttcctggcagtagtttcataggttgaggtcttagatttaagtctttaatccatttttatttgaattttgtatatggcgggagatacaggtctagtttcattctaatgcccatggatatccagttttcccagcaccatttattagagagactgtactttctgcagtgtatatccttggcacctttgttgaaaatgagttcactgtaggtgtgtggatttgtttctgggttgtctgctctgtttttactggactctgtgtctgtttttatgccagtaccatgctgttttaaatactctatctcagtagtataatttcaagtcaggtgttgtgattcctccagttgtgttctttttgcttaggatagctttggctattcttttgtggttccgtatacattttaggattttttttctattttttctatttctgtgaagaatgtcattggtattttgatagggattgcattgaatctgtagattgcttaggtagtgtggacattttcagaatattgattaatccaagaacaagcaatatcttttcattttttggtggcttcttccatttcttttatcagtgttttgtagtttccattacagagatctttcacttctttgattatgttaatttctagatatttaattttatttgtggctattgaaaatgggattatttttgttttctttttcaaatttttcaccgttggtatgtagaaatgctactgatttttgtatgttgattttatatcctgtatgtttgactaaacttgatcatcaattctaatagttttttcttggagtctttagatttttcccaatttaagatcattatcatctgcaagcagtggtaatttgacttcttccttcccaatttggatacactttatttatttctgttgcctaattgctctggctaggacttccagtactatgttgaatagcagtggtgaaagtgggcatccttgtgttctagatcatagaagaaaggctttcagttcttcccgattatgatattagctgtgagtctatcatacatggcttttattatgttgaggtatctttcttctatacccagtatttttttttttttttttgagacagactctcactctgtcgcccaggttggagtacggtgacgtgatctcagctcactgcaacctctgcctcctgggttcaagtgattctcctgcctcaccctcccaagtagctgggactacaggggcgtgccaccacacccggctaattttttagtagagatggggtttcactggtgttagccaggatggtctcgatctcctgaccttgtgatccgcccgcctcggcctcccaaagtgctgagattacaggcatgagccaccgagtccggctctatacccagtcttttgagggtttttattatgaagggatgttgaattgtatcaaattctttttcagcatcaattgaaatgatcctttgatttttgcccatcattcttttggtatgatgtatcacactgactgatttttgtatgttgaaccatccttgcaacccaggaataaatgacacttggtcatgatgaatgaccttattaatatattgtggaatttggtttgctagtattttgttgaggatttttacatcagtattcatcagatattggcctgtagttttctttctttggtgtgtctttgtctggttttggtaccagggtaatattggccttgtagaataagtttgagtgctccctcccctgccccctctattttttggcatagattgagtaggattggtatttgttctttaatgtttggtagaattcagcagtgaagccattatgtccccagctttcctttttgggagactttttattatggcttcgatctcattgcttgttattggcctcctcaggttttagatttcttcatggttaaattttggcaggttgtgtgtgtctaggaatttatctatgattttccaatttattgccatggatggatatcgctgctgctagttattcagggcccaagagcttttcagttagcaggtgatgcatgctacctggactgggtccttccccttaaggcaacaggttcccttttgacccagagtgcatctagaaatgtctatcaggagctagggcctggaaagggggcctgaggactctgactggtaccctatcctgctgtggctgagctggtatcccaagacgcaaacaaagtcttccccactcttccatttcctctccccaagtgaaaggaaggggccttctttggagccacgagctatgcaacctggggttaggggagggttgatgccggtgctcccttagccatcccagctggtatctcagtaagttgtgtgccgcccccctagtccactgtctctgggcccagcttagcactaggacttgcctaagagttgctgtccttgtggcctagacggcttttgcagtttatttggggccccacatcgctgtagcccatggtggcgaagcttgtggaaactcaagttcagatggctgggattggtgattgattcccctctggttaggactcgtttaaatgctccctccatgggtgaacatcagctgaatttggttcagttttgttttctgctataacaacgtcagagctgagtttaatgcctcagaattactggctttctttctccccagtgcacagaaacactctcatcatcaggcagctgctgcccaggtttgggggaaagggggcattggcaattgaagactgtttttcctacctcttctgtgcctctttcaatgatatgaagttaaaactaggtattgtgagtactcacctgatttttggttcttatggagatgtttttttctgtggagatagttgttaaatcggctggggggacaatccctcctccaccctttctagagataaaacatccactttagtatgtctaggaagatacacaactttgcggagattcccataactgagatatggcacaaaaattactcttaaggggctatgaagaatggaacaagagatgactatgggagttgttagctggacaagaacatttcatctctacagacccctcaaccctcactcacaactcacattgctgtatatcatcaactattatattagataggctgccttgacttcaactcttccccaaggaaagtcaagagaaattataaactgactgagttaagtttttgaaagagattcaaaatggaaattaaattgttatagaaaaattgaaattgcttttcttttaaaacaaaaacaaaaattttcttcaacctaacattggtagctctccataatatgccccatattattttctctgccttctttcccactgcattttccccacatagcttaaattttaaccaaatcagtctgcttacttcttattgactgtgcatttgttcagtgtgttcacacactttgaaatgttctttctccctaaaccttcaaattccagatttgaaagccatttagggccaggtaaaatatcatttccttcacttagttaatccaggattatcagaatttatctcctttttaatgggatcttttgttagaatttatcttatctaccttctatttgtatttgaatgttttctcccctcctacttaatgaaattgtgatggccaaataccaagggtaatttatccctcattacataatagtatctggaactgaattgcatttagatgacaaaaaacatgttggtgaactgaattgtgacttcaataaataaatgaatgcaaggaagagaggaaggcagggagggaggagaaaaaaaaggaaaggaaaagtataatattcattgcttaaattaaccccttaggcatgtaaagacattttgataataatagaatatgttgaagtgttgagtatgaaggtaccattatcaaaggtttacatagatggattatttatatattacttctaagtaaaacaatatttttatattatttgtaaaagtatacaatatatacacaaaaataagacatatggaaatttatggcatttataaagttccatgaaatataatagtattattattagagatatacactatttcccttcactatctctctttatatatttactattaataacatatgcactgttcttatgattataatatacaattgatgagaaatattacttgttctgagcattgtgacccaccaggcgcttaaaacttgttgacaaagtatggagcatcagtggtaatatgtaggagtaaaaattgttctgttattctgctcagtatagcaattgcatcattgtttcacagaaaggataacattatgatcctgtgtgggtgtatagctcatctgtgggaggatgtttctgtgcatacttagtgatcaaaattcaagaaacacgcctcatttttatgaatattttctcattaggaatttggctcatgtaaatgcatcacataatttgtagaagcattatatggaaaaggaaaaagaagaaatgaattttttttgcatatacaataaaagcttgagctactgaagagaattcctggtagtatatagtatcgtgactggaaacccagtctttaaaaactaaatttaattctaacctaaaaataactggaatgtcagaggtgtacctttccacagcatgaataggtttgtaaagtatagatttatccatatgcaatgctattttctctttaaaacttgagatatcttttgggaaaggatttggccccaagtattaataaaacccatactttagaagcaagtattttaaaatcacctgttgatggaagtaaaataacttagtaataaataaacccccccaaagtacctagagctatttaaatacttaacatgatgaaatgaatgccataaaattacagcttaacaaaatataacatagtcatttagtttctattcttctccctaatataaagtagcaggttaatatgcattctctctgtttggttttgttgttcttttttttgttttgaggcagagtctcactctgtcacccaggctggagtgcagtggtgcaatcttggctcactgcaacctctacctcccagattcaagcgattctcctacctcagccttccgagtagctgggattacaggcatgtgccaccacacccagctaatttttgtatttttagtagagacggggtttcaccatgttggccaggctggtcttgaactcctgtcctcaagcgatccgcccacctaggcctcccaaagtgctaggattataggcatgaaccactgtgcctggcttctatttttaatatgctgcatcctcaccctttgtggaaagcctctgggtttcaataactagcaagccgatcttgctgaaagaaggtagagatacaaacaagtagaagcaactgttccacataaagaaagaaataagtttaatgggaaaaaataatgaattgggggaacgtgcaatcaaaatacaattctgaggatctcagaactatttggagtgagctggcagataatgttataaaaagcaggttaccagtttatggattctatatatttgataattttgggatagctttggtgttcctgtatcacatggtaatcctataaaatagatcaagtgtttctcgaaataccatctttataaatatcatcttggaggcctcactctgaatcaactagatccgtacttctgggaatctgcattttaacccacccctcaaatgattcttatatatgcagaagtaaaatctgaaaattactatagtagcttaactgagtgtggttacattgcttttgtgatgatgccattattttctctttctaaagacccactgtttccaagacccagttaaaagccacctttcttgatttgttttaacacagagtttagtttcttcctcctctgctcctctagctcccataattgtgcctttgttacactaatcaagagtatcccaaatctcttaatgcagatttaaactttaataactttacatacgtaagtgctacaaccttaccaaaaacattatttaaaatttatttaaatttattttacaatcatttagttttgtttattttaaatagtaagttcttaattttaatatttatatgtggcatttttttggactggtagaaaaacttgaccacctcaatcacctcatatatctcccttaaactttcttttgcagggtcatgtcaaaatagttgagtgtgcaccaatattttattcttcaaataatcttaaatctaggatcacagatgtcatcctttctgtcactaacccacagctggtagaagtttttgaaaagtttgaaatttgactagagcaatgtatagtacaacccagtatactatatgttgaattttatttcctgttgaatgttaataaaaatatattaatatcttaaaattttaaataattggccttttatctattgatttgtgtaatggtgtatcatttatacttctaaagttaaaaatacttaaaacagcatgaatactttgaaattctgtgttttaacttatttgtgtgaattcctatctccctaaacagcacttctctaagtcaggggccatgttttattcatccttttgtctctagtacagttgattaatatttgctgaatcaaggggaaaaatatgtctattttatattgtctaattaatttagtatattcaatattatttaaatattactaactatatttagatataggtagcacatttaaaatgtaatattaatatagcatcaaacatatatttaatagtatttgttgtgtttccatccattgcagttattatccttttagatgctcaaattgttccatgtttgactagggggaatctcttcatgttgagtcctgagtcctactaaaacaggagccaactcctgtgtagtggtagtcttgacagattactcctagtagtctttgataacttccttctgtcttgtatcacagtataatccaagctcatcttgtacgtttcctattccagatctcaaatcagccattttccaagaaggcttggaaatgtggttttaagaccataaagtctgggaagtgtatcattactaggttggtcattgttcctatgccttttcagggtgcagtgctaataaatacatgcatacatgtatatacatatgtacatagataatacttcaagagactccagcatattatttaacttcttcaatcttatatatgtgtctgctttatcccatgctaaaaatacttatcaatgacactggagtgatagaatggcagtcacataattgttcagttattcatcttataaagcacacacagcagattctgcatgacaataataatcacaacactaccatctaacatcatatgattactgaaaacagtttaagattattttaacagttctttttgttggatcacattaggaatgtgctagtaaatttttatattttaaagatacttgaaatagttactttccgtatgattattatccactactagagtatacattcagatcatgtttactttgtttacttttttccttgaggagaatccctttgaagtttgaatttttagtcataccctctgattctgggaaggtaggcaaataatggaatttgcatacattgcagctgaagcaagctgtagaagcagcatgtggaagctgggcaagttcccaacttttcccagattatctctcctttggcatatgagtccctcagaaagacaagacccaattcttaagtatttctgtgaattttgtaaaatatacttaagttttatttttaaaactttgccccgatctgcatatgtatttcttctgacaaggcattgtggtgaagttgcattatcaaaaattgtgttgaacaacattccttttttgttaaaattaaattcaggaaaaaatgaaatggagtatcatttcttaaaatattcagtactgtggaaatgggtttgttttttttttcaaaattatccaaataataattaattttattttttgaagtaaagttagttttttaaagttaaaatagcaatggccaggcgcagtggctcacgcctgtaatcccagcactttgatctgccgaggcgggcagatcatctgaggttgggagtttgagaccagcctgaccaacatggagaaaccccatctctactaaaaatatgaaaaattagccgggcatggtggcacatgcctgtaatcccagctactagggaggctgaggcaggagaatcacttgaacccagggggtggaggttgcagtgagccgagatcacaccactgcactccagcctgggcaacaagagcaaaactgtctcaaaaaaagtaaataaataaaatagtgacattaatacatggttaaaatgtatttatcacttaatgtatgtcagattctaatgacttatctcattttgtcacttaattctcacagcatttttattgggttgctaccagtatgcccgttttataaattttgtgaggaaactgcgccatagaaacattgtctctaagcaaagatcagtttgttgtattactgcttattgtatatcaagtaattgcaggttaaaagaaaagaccatggtggtttttgaaagaattttttgtaatttctgggacttaaatttaggtgagaactatgaacttggtaattattattagtagatgtattaattttaagtgtgtactgtaaagtatatttaatagcttgcaatagttgaaaatataaaagtatttgagattttgataggactattgaaataaatgttagtgtgttttttaatgttctaatctataataaattagtatttgaaatgttagggacatttcaacagaatacatttatcacgtgtaaaagcttagatagaaaatggttacaatattttttcaatatttgtttttaaaagtctacttaatgtatattgtcctttagtatgtgtttaaaagaagtaaagttagaatatacagttaagcaaaaataaggatagcctctgttactgaccatcagagctaaccattattaatattttggtatgtagcatcctagatttttcctgttattattgcttttacttgaattgttaagacttttaaaattatagtataatttctaagaaaatatttttaaaagaatgcttgatattttgaatctaatgtatatggttcttttttttcaggattgtactgtatatgaaacagagaataaaattcttcacgtggtgagtatacttggatttattttaatctttattagaggatatttccttgttcaactagaagaggtgaaccataagaaaaaaaatctactgaccacatcagttaagtgtatttttataggaaatctacaaaacaatcaaagcataacaagttacgttagttataaccattctattgtacctaataggagaaaaaaggtataatattttaaaattgtaatgtgtagcaaggttggaatataataaaaaattaataatgtagagcaaggagaatttgaaatgagaatttcttttactgttcatctattacaaaaaagatcagagaaaggtattctgttctataatgggtaattcatctctatcatcatttggatgaaatactttattaaaaaaatcaaatttcctttgctccaattctatacctacgagacaacctttcaaatggtaatatggcaatatttttgaatcagttaatgactttacatatattttattactagaaatgggctacgcgtacattatactttgtggaaaggccatctcctgccttcttaatgaacagttggccacttttatttgtaaatgcatttcttgatcaatgctagtttgtcctaataacttcttcacctctggtgtgtgtgaaatcatgtcatttctgcatctgccaggtactaggcggtgaagatccatatgtctgtaaaaggacatttgcctcatttattcctaatatcagtctattaagttttatgtttctgaaatgtttgaatatttataaaagaatactattttgtatttagaaaaggaaatacttttaaaacatctaaacgtatggagggaaaatattacttcagaatatcagcagtacagcatccctattccttttttgttatctgttatagaaatgatactgaataatcctctgctaatcctctccccctcattgtgcagtagtgatgccctttgtggtttataagaatagtctcaggagtggataattaatttacttttctccttattagtccaggagggaaaataattacaactccctcacgttgatctacctgtagggcctggagaatagaaagacactaatatttatttagggcctatatatttcaagtattagcttaatttcttataagcatattctctcatttaatcctacttttgcagatggtggaactaagggtcacaaatattaagttgttcaactattcggtttgaacacagaatctaataccaaagcccatgccctttccagatctggcagttgctaccaattctagctccctgaggctttacaaattgtactatcttttttcccgtggaacccagggctactgtctagctgtgcctattttgtcaataactaaggagcatgcacagaccctttcccacctacattttattttctgtgagtgactgtttctttagcattgaattttctatgacaatgactgttctttctgaagtattgaatttactgaattcgactttggtatgctgctgtgggttcttcattgtgtttacttcaaggctgttattgaggtcagtgtgtgttaacatttttttctttatcaagtttctcaggagtaatctccctgatgttagtatcaaaaagagctgtacttttcttcatgcattggctgctacgaacttaagattaaaatttgtggcccataattgacaagtgcatctcatggtatttgttttgtatttagcttcattcttggctctacatgatttctttttgccttgtttttctcaatttatgtatggtatatatttttacatctgttgatgtagccttttctatggaggaatagttccagttacaaatgcacatttgtgatcaatattcaaatatcaacaaaggaaatgtaaataatttatggaaaaagaatctctagagaactgtaaaaaatatgaaattttatttctgaggaaatttcagattctaccatatgacagaataacagaaatagatttaaatgatgaaagaaatactgtgggatttctcttgtacaaaagactttaaatataattttaattaattagactaaggaaataatctctttggggttataaaatgatgaatgaaattttattaaataaaaaccataataagtaatagccaaattttaaaagttcttaatcactaaatatttttaattttaaataattttaaaataataagtaatttttagtttcttaaataaattcctaataattgactcatattgactttatctttctcaaaagccagattctgggctacttgctattagaaataagtaacagcataaatagtactgaaggagtttagaaatgaatgccgtatatttaccttggcaattttgcattccagctagtgagaatttaaaaatcctgtctgatgatgatgacaacagtgaatggcattaaccaaatcagttcatctcagaaagcacttgtcttttcatgttattcttctacttcccatcctgacgtttttatacaaagattacccagcctttaccaaaaggttgtatgtatacttgtatattacttttttcacaagaataattttttagaataataaaatagtatacagtaccacttagtatatgaggctagaatagtttctttaaaacaaaatttctagaataagtatctttctagatctctatagtgtagaagaaataactttgagtctaaaaaactgtctgaatcctaattctaccattttctatctcggtgagctgaatcaagtgatgtttttgagagtttgttcttattatgtaaaatggggatattaatatctttcatgaatgattgttgctaggataaaataaatcagtaagttttctagacagagctttataatctggtagttctctttccagtatttattttttaggttatatctcattatttaggttttttgttgttgttggtttggtttttttttttttttttttgagacagagtctcgctctgtcacccaggctggagtacagtagtgcgatcttggctcactgcaagctccatctcccgggttcacgccattcccctgcctcagcctcccgagtagctgggactacaggtgcccaccaccacgcccggctaattttttttgtattttttagtagagacggggtttcaccgtgttagccaggatggtctcaatctcctgacctcgtgatccacccacctcggcctcccaaagtgctgggattacaggagtgagccactgtgcctggcctatttagggtttttaatatcttctttctctcctttttatatggaccagtaaatcaaaagccagagtttttatatagcttgtttaggatgcaattgtgagttagttttaatgttttccttgtttctatgatacttgaatattctaagtacaatatgatttataatggctccttttcaaagatgaattaatatgtattgtatatgagcatcttagcctgggttctttctggaaaacagagcctacaacaaggctcgaatgcagatagtttgtgttgattagttatcccaagactcagaagagacactgggaaggagaatcaatatgggttctagaattgttcaccactatagggaactgaagttcgatcccatcgggaccttctgagaagccctgcagaatttgccttggaattgtccaacctgcctgacaaaaactgaagagggagaatgtatctgctggctctaatccaattatcccattggtcaaagcttgctccttggggtgttaactctctcacactaccaggtttttggaggtaccagagagctctaggacagaaagcaaaggtagtgcaactgaagtgaagcagattgccacagcagtagctggagaaaaaagtgggctgagtgggtatgagatggggcttaaggggtgtctggtataatgaaacgcctctaagtggcaatccaaattttaaagtattttggatcacataaagtatcctgatagtgactgaaatcaagatttgcataactcacaaaagcaagcttcaaacagtagacataacataacttttgtgtaaaaaagcagtgtatttatagtgaagaaaataatttcaagaactatgcaacagacttaatgttggttgtctttgcaaggaataggataaattttagaggcattaactttaaattatgtgtttgtataatggttaaatatagcataacaaatatgtgttaatcagaaaaaagtagtactaaaatatccatagaaatgcctgaatagcaacccaaaatctagattaaaaatgagtattttattgttagatacaatgaattagatctactacttgatagcacaacagagtgactacagtcagcaataatttgttgtacattttagagtaactgacggagtattactggaatgttcataacacaaagaaatgataaatgcttgaagtgatggatacccccatttaccctgatgtaattattcacattgtatgcctgtatccaaatatctaatgtactccataaatacctaatgtatacctactatgtactcaaattttttctaaaaaataagtatttttaacaaatgagtaagagtttcaaatgggtaaggagtgaaaacagtgccagtagccaaccattgactaacctaaagaacatggctgaaatctttctaatgccaggcagatttagaatcctatgtaatatattaatagttcttaggaaccttttcactttagtacactggactgtgagttaaataggtttttagaacatccccagtgatggctgccatttagaaggaacaaggagaccccagatgactgaatagagattatagtagcttgagataggcgctagaacatcaactgtcttagcctaaaccctacccctaaatctttattttgtccagaggatagggaaggcagttttcaagaggaaggagaacttatcacttatgaaaacttgttatagcctaggaattccacaaggcaatacaggttgattgtcccttatctgaaatgcttgagattagaagtgtctcggatttcggatttttttggatttgggaatatttgcatgatatacttaacagttgtcactaatctgaaaatactaaaccaaaatgctccaatgagtgtttcctttgagcatcatgtcagtgctcaaaaagtttctgattttcggattagagatactcaacctgtacgagtgtcagagtgcccttcaacacatgggcaaactgagagagctgaggttgtgaggtggtgtatctttccctgaaatagatctgtatttaaggatgggtaaagaaaaagaatgggtaagaggagaggaagtatcctctaatatattagaagaaaatccttccacatgaagtaggtttattatgaacacttgtttaatgttttcagttgagccaaaagatattacctgtattaaaaaagaataccatactataaagaaggtaaggtcactataaactgagagcaaagtgaactaagaaaatagtacattaaactaacatggaagcagaaaataaaccatggagaaagcatgtatcttcccaatttttttcaattaatttgcatttctttcataatgaaaaagtataaaagtatgtatttattatagtatagttagaattctgattgcttataatggatgattttatagtacatatattgaactagtcagaagggacttggacaatcctcaggctacattttctgttcacttttctcacctctaaaattggagagagtctttctgcttaaaatcagaaagaagtaggctgtgaggaccaaaatccctggtgggaagggagattggttgcagtgttgggcagggatgtctgttaatatgaagtgtgagaatgaataaaaggagactgaacatcttgggtttcctttgaatttgccattaagtataatggaacagacaatagaatacaaccataaaggacaaaaggcaatacagataatcaatatagtatatatctcagtgattatcgactaaagataaataatattatgtttcacttctattgatctgatcttttccttccagttagtttttgttctggattacacattctctggcaggttagagcccatctgttttgctctgtgcagatccttgttttatataacaaatgagttacagagaatctggaattttcagttctatactctacttactcctcactcctgcctttcagtacacccattgagtctggagtgataagctctcctgagaagtcatttcagagcttgtgctttagcagacttcctctgcttgtccctgccctgccattctcattggtgagcctggaacacttgtcggctttgattaaactcatggaaatcccaggccaggcgtaatcattaaggtcacattgtttaaatcagattgttctgagctcacaaacaccttttacattagccaaaggtatggccttgtatatggcactttgtattttagcattttaccccattgcttttgtaaagataataaatactgcaaatgcctattttattattttagtgttaatattatcttctagttatatagtactttacagtttacagaacattctcaggaatgctttcttctcttttttctctttttttttctccaagctatttttttcttttgttacttaggtttgatcatgaattaggcttattttggcatgttaagtatttgttttatttcataaacattctttgtaattttttcctttctttaaatttatgaattccttgcccttaaactccatctggagtgagattattatgtcttctctggtatccagactagaaatagcttaaactgcatagagccaacagttagatgtaagagaggatcctggaggagaaagtaaagggctcattttagtcttttccctgacatctacatcatatcatttatgaaagtatagctttcctcttctgatggatcaaaaccttgaggatgtgtttaagtactggtgtagcagcataccccaaagtgaaataaaagtgatcatattaatgttaatagcttatctttagagatttcttgaaaacaatggtactctagtgacttaaaaatccctgaagataattttaactcgtcttcaggaggtttctgatgctgtgatgaagcagcttttgccagttgtagcccagactcttctaaaagctatgatcttgatccaaatgcaaactgaattttttttcagtatggttgagattttgttggtaactgtagcatttgaacatataaattatggtcagtctcactaaaacatcaactctaatactgagttttatagatgaaaaacgtaagatgcttctttatgttttcgaagttaaggtcacccttctgtctcagccccctttattatctttgtggtcagcctgaagaaatgtgctaacaatattgctgaaataggcgttggattctttggtgtcatattatattattttcagattttgacactttggtggttaattgcattgtaaattattttaactataaattctccacaactgatgcctcatgcaggaaaggaaaaatgagaaatccagatataacatgatagaggtggaaaatgtttgtctttcctgggacaaaaagaaaatgtgtgtggcctatgtgaagaattaaaataatctggttttagtgtttctgattatgatttaggtagacattttataaggcagtatatttatttatataggtgtttttgctaacattacatttgctgaacacattatgcattgcaagatgcttccatattcatactgactctgaaagtacaattcttgtcctcacagtagtattcatttttgttggggagtcaagtgaggtagaataatacagtagaaagagcagcaatctgagagttaaaaggataggtgtcctgaccccattctggcatttactagctgtaaagaagctaagttagcctttctgactaagttgagggcttggagtatctgtgacttttaaggtctaaatgccataattcttagatgacaaattcacaagatcattagaaagcagtatggccacataaagcgataaattgaagaactgtctttatttgagaccactgtatatatgaccaaggacactatatatttttaaaaataaagttagcaggcacatattcagttttgatacatgggcatattgcatagtggtgaagtctgggcttttagtgtagccatcacctgaatggcgtacattgtaaccattaagtcatttcttaccccttaccccctcctaccgttccactcttctaagtccccagtgtttatcatttcacattctatgtccacatgtatacactttttttaagctctcacttatacgtgagaacatgtggtatttgactttctgtttctgagttatttcacttaagataatggcctccagttccatccatgttgctgcagaagacatgattttatacttcttatggctcagtagtattccatggtgtgtgtatacacacacacacacagagacatatatgtacacacatatatatcacattttaatccagtctgttgatggacacttaacttatttagttccttatctttgctattgtgaattttgatataatatttgttttcctttgggtagatacccagtagtgagatagctggatcaatgctatatatttttttaaagtgcaattatagtcactgtcaatgtaaagatttcttccacaaggtaattgaatcagtctggaaacagaagccacacagtaacttaaaggaagtttgatataaataattataaattatgataagaaatacctgcaaacaggtaaagagcgccctaaaccatgtcctacaactgaggaatagtacccaaggaaggatatcttttaagtggaacacccttcccaaggctgagaaggtgtggctgcagcttcattgggttgcatagatcagagcttatccacagttgccaggcaagtggaagacaaccttcgaggatgtaggcaaatgatgctgctgggaaggttcacagcaagagttaggatgatgctgtgagtaagaggtctggagagcatgctgagatagcctcaggatggtgatcactgagcccaggctgaggctgcaatgtcactgtgggactgcatgatctggacatgtggctggggcacagcactaccgatatccccacacacatgcactgctagtggaccctgcaacaggaacaagaaaaaaataaaagaatgcccatgggaacctagaagccttcttctccttgcagtgtccctccactgccctctattgacaaaaacttaacattgtgcttactgtacaagataaatgcttagagtccaatccattgtcacagagcaagcactgaaggatgaattgagctgagagccacaaaactcataactgacacagtgtggttagctcttacctccataaaactacatatagctacttcacatttcttgactataagtgaagacatcgctcccaggtctctgccgtttggtccctatttatccataaagtgtatatatatagtgccttaaatttccagaagcttatctaattataatgaactgcttcactcttgctatttgaatataaaatccaagctaaaatcaaaacatttttctaataacctacatcttagttgagctatcaatatgtccagtctgttctttttcttgagcctgaaagtcatgtgtcctctaatgagtgatctctcatcttcttcggaacctgccacaagcctgcttgtctctgtttcctgcctatgaaacagcagataaatagaattgagattttcccagatccaattctggtttccagcttactctatttccctatcagaagtgagagtagtggtggagcctcttgtcccaactcttaattcataccagattgtttcaggtaagtagctgaaagtaggctcgaagtgtcatgggtgaacttcttactcatcaaaggtgtacatttgggactgacattttctcactgttttggcattgaccttatcattcttagatgattattatcttaaagtgtaatttttaggctgtattattatctcaatgttgggctcactaggcattaaaatatttgatatttacttgccaaacaatgttcaaagcacagtggttaagcacgcaggaactgaagcaaaactgcatgattgtaacttggctctgccatttaaaagttgagtgaccttgagcaagtttttaacatctttgtgcctccattcctacatctgtacaatagagataatagcagtatttccttcttagggaggttgtgggggttaaatttgttaatacatgtaaatgacttagaagaatacttagaatatagtaagctttcaataaatatcagttattgtttcatttagtcctcctcactatacagtgagatcggtattatttttgtcccaattgtatacataaggaaactgaggcacacaaaaggattaaacaactttccccagatcatggagctagtaagtggtgaagttactattcagtctgaggcttttaatcactatactatagctgactctgtagatgacctcgaaatctaattctaaggtcataaattatagacatttaatttcagtgactttcttttgtctttctattgataattttcctttggcattcatggtagacaggattctaagatgacccccaggacccctgtcccctggtatataactgccctcttcttcagtgtggttgagaccagggaatacaatgaatttcactctcatgattaggttttgatctatggcaaaggtgaaggaatttcaaggatgtatttaaggtctcttgtcagttgactttaatataattaaaagagagattatcttggtgggcctgaccttatcatgtgagccctttaaaacaagattcaaaggaggcagatattctcttgctggccttgaagaaatcagctgccatgttgtgagagggcctgtgtagggagtcacgcagtgaggacctgaggacagcctctgggagttgagaacaatctccagatgacagccaacaggaaagtggggacctcagtcatacagccacaaggaagtggattctgctgacaacctgaatgaacttgaaagcagattcttccctacttacacctccctgtaggaatacagccaagttgacagcttggtttctgccttgtgagaccggggactggttccagtgcctggactcctgagccatggaaactgagagaatgtgtgtttctttaagcctccaaccttgtagtaatttgttacacagctatagatacctaatacagtatcattaatttaaatttcaactcaagaagaacaaaaacaaaaaatgtattttttaaagccaaagagagactagtagccagcagagaataaatacgagaacaattcttttgagaatttaaatataaggtactatattgcctcctaacttatttgattcatgtcttatttattataaatacttttttgattagaggcaacaacatgtcattgtgaaaagaacatttgactaagcatcagcacttctgggttttagtcttgacttttccatgaactttgttgtgtgacacttaacctctcatggatccccgagtgtcattcaggaagattaaacaaaatgatttcaaatcatctgtctcaaaattctgtgaatataaggatttaagtaattagaagcttgtagtaacaggactaacactgtcaataagctttaggacctttaagttttaatgtgggaaaatgtaagaaattaggaggaaattatgcttttaagatcatgaattttgacttactaattttaacgcataataggctgttaggggtcattgcttcttttctgttatcaggaacacaagggcagcatgctcagtgtcagtgatggtaagcacaaaaccaaatacattagcagaaacactgtcccaggctatgaaattcttgagtgtagtagttggcgtttgaatcatgtaacagacacttagtgattgttgaaggcatgaatggcttaatgaaggctggtgatttttgttgtgtttttccccaccatgagagtttgacatgtaaagggattgtaggagttttccaggccttattgggatgaagttcacatgacctttatttacttgcaactatttgctttctcaagctatttgaaaatcttagtctttgctgtatataaatataattttaatattgggttaaaattggaattttattctattacattagtttttcaagtttaaaaagtttttctccttcaattctctgtactcgtatgaacaagaaattcttcctgtgttgcacgtatgtttattacggcattactcacaatagcaaagacttggaaccaacccaaatgtccaacagtgatagactggattaagaaaatgtggcatatgtacactatggaatactatgcagccataaaaaatgatgagttcacgtcctttgtagggacatggatgaagctggaaaccatcattctcagcaaactatcacaaggacaaaaaaccaaacactgcatgttctcactcatagatgggaattgaacaatcactcataggtgggaattgaacaatgagaacacttggacacaagaaggggaacatcacacactggggcctgttgtggggttgggggagcggggagggatagcattaggagatatacctaatgtaaatgacaagttaatgggtacagcacacgaacatggcacatgtatacatatgtaacaaacctgcacgttgtgtaaatgtaccctagaacttaaagtataataaaatatatatatatatatatatataaaagaaattcttcctgagttggagaatgtgtatatggaataataattttaaatactaatttaaattctgtttctgaatgttactctttcaaagttacctatgattgttcaacagttgtgtcttgttagggaaccatcataagagtgcaaaatttctagctcaacagaaatctgtcaagtactaagatactaaacatactatatttagtgaggcgtatacttacagttctcacaacttaatatcagaataaatgtatgatattttataaaaaacaaagcctcccttgttcccccagtacaatgcacatgtcatcctacattggcacagagttgcagaacttataatactgaattatactaatattcaaataaaacaataaaataaaaacatactggctgggtgcagtggcccatgcctgtaatcccagcactttgggaggccgaggcaggcaaatcacgaggtcaggagttcaagaccagcctggccaacatggtgaaaccccatctctactaaaaatacaaaaaattagctgggcgtagtggtgcgcacctgtagtcccagctacttgggaggctaaggcagaagaatcacttgcaccgaggagtcagaggctgcagtgagctgagattgcatcattgccctccagccctggcgacagagtgagacttcgtttcaaaacaaaacaaaacaaaacaaaacaaaacaaaacaaaaacccatactttattctttagacattttaattgaaatattatttatatcaataaatatttaaacatgtacacaactgtttatcaaaataaactttcattactattttccatgctattgataataagcctgaattgtttaaactgtatttaaattgtaactttcacatcattgttgccatcttaagatgtatatctatctgttgcttccttaatttatcttgattttatattttatactcttattccttgtatatacgtatatacccaaaaagtataaatttctttttgtaaagctttttttaaccttatcagccttgagttctttcctgcatcaaatgaattttctgactttttaaactaaagatatttttattcatttgttccagtatacttggaagaataattgaacagtaccccacttacttagaaaagcaaataaaaatactttaagtagctcaataatgcctaagtgtgcttccagactgacataagagttttttctgtcccttagctttttaccactgtttgcacttagaacactttctgcatttcttttttaaaaaaacaatagctggccaggcgtggtggctcacgcctgtaatcttagcactttgggaggccaaggcaggcgaatcatgaggtcaggagttcgagaccagccaggccaacatggtgaaaccccatctctactaaaaatacaaaaaattagcggggtgtagtggcaggtgcctgtaatcccagctactcgggaggctgaggcaggagaatagcttgaacccgggaggtggaggtggcagtgagccaagatcatgccactgcactccagcctgggcaacaaagtgagactctatctcaaaaaataataataataacaatagtagctaaaacttcatgtattaatcttaaaagtatctgataaattcagatataatgaaagaaatctattcagacataatgaaagaatgctatcttattattggttaatgtcttaatgtgggattattattttttgaatccccacattaaaatgttgctttattttgtgctaaatatgctctgctctgatctttttcccctttaaagcttatatttaggtaaaccagcgtgtatgtgtgtgtgtatatatatatgtatgtgtgtgtgcgtgtatgtgcagatagatagtatagaacagaatacaaaaactttgcatttcagcctgagaatatgatgtattatattcatatttgaaattaatataaactacctgagaaaaaaaacacacaataccataaaattcagcatatgacactcttcagttttaaaagattaagtcatggctacccttgtctgttattcagtcattaatcctttgtcaccttgggtagtttataacagaatccagaaagtcagttaaacatttatttccatttcatgttctctgtagcttttttaaggcatatcatttactattctttaattttaggtacaaatttttcttctatttttagaaataaagataaatataatttaaaatacctcgggggctgggtgcagtggctcacgcctgcaatcccagaactttgggaggccgaagtaggtggattacctaaggtcaggagttaaagaccagcctgaccaatatgatgaaaccccatctctactaaaaatacaaaaagtagccgggcgtggtggcgtgagcctgtagtcccagctgctcaggaggctgagacagaattgcttgaacccgggaggcggaggttgcagtgagccgccactgcactccagcctgggcaacagatcgagactccatctcaaaaataaaattaaaataaaataaaataatttgatatgaatattgcgaaaatagcaaataataacagtggttactagtcatcttctagctagtatagagttgtccttttgctggtaaaattgctctaagttttcccagacagccatgtctttcacagtctcagttctaatattccttatctaaactacattctaaattgcaagaacacttgcaagcctgccttatattttgttatactatgtagtttaaacatgttatataacatccatctaatgtagacattgattttaaacaatacaaaatgaaattgatcaaaaaaagtccagtgctaagcatagaaacagaattagcacaataatgattaggaattcaagtccttctgccatgctaatgaccttggtctatttagcctccttctcacatctgttaaactcgctataatacctactttaggaagttgttattaggataaacgagataataaatatgaagtatttagcattgtgccagacacatggtaggtgatctacaaattatagctaataataatgttgttgaattataataaaagggtatttttcttgctattttatgattttctttttctagaatatgcttaggtagtaatagataatattgtgttttaaaatataaattataataatataatgtctcacatgatttcacttaatgaatagcattgaccaaattcaggttttgtaagatacattaaataacttccctggaactttcctatagtgctgctaatgtggtttcctgcagtaacttgatgtatgatgcagtaatgagtatagaattagcatgtaaagcaagaccattttataccccttctaattgccttatttagttaagtgccaaatgctacaatataaagtttctagcgtattatctctaaaacaggaagcaaagttctaatggggtttcttttctaattctattttttaagacctttaatctgttaactcctgatagctttgctggtaaagtcaatgtgtttactcaccttttgtattcctagcagcacctagcacatagcaagcatttggcaaacaaaattactcaagaggaatctgagaagacgtttttgcaacttaatatgatgaatttaattggtattttcttttccctaaaatgtctacagtctggtatttctgcctttcctttttccactccagttctataaaactaccagtgcctgaataggagagctactgttgctcattacaagagtgttatatgaggccttgaatgttgtaagaaatatacatatgtatatatagacagagagccatttatatacatccattactttcctatttatgtattggactcttttgaaatatgcttcaatttgtagaaaccacaagggttctttttaacatactgacttcgtacccttcagattagcatgctatccaagtatcctgtatagaaacccttcagcattcacagtgttatctcccctacttgagataaagagaaaataagaatgaaaatataaccacataggtaagggaaggaatagctaaaagatttaattctgccattatttttcttcctgtcaaacatagaatttgaaccgcagccagtttttatatgttaagtactgccattctgtcctttctccatggctgctgatgtatatttttaagacaaatttttaaaaatacagagaatgggattccaggatgggccacataatttgtgagacctagtacaaaatgaaaatgccaagccccttgttcaaaaacaattaagaattctaggatagcaacagcagagcataaaaccaagtgtaggcccatgtgcaactgcacaagtcaccctcccacaaagctggccctgaagggtttcctatttcaggggaatgatcttcctgttggcactttgcctagcagcttttcagagtaaataccttcattgtatctaagagcattgagacctgagcgtcagagagagtaaagagatgtgaactgtccatcatggccatgcagctagactaaccagtgtagttactgatcattgtaagatggtcagcaaggtaattcaattaagaataatgagataattcataccatgaataggatttcagtattttaagggttgagaaagcaacagaggaggaaaaagcatttattgggtgtcttttttggataggagccatattgaactctttttaatgcattatcatgtcttagcatgtcagccatataaagtaatctttattagctcatttcattttctatctgaggaaagtgaatctcaaggatataaaataacttgtttatagtcacacagcaatcattggcagtgtggtgattgcccacaactgtcttcagatcaagcccatgttctttctatgggtattggtaccatgaggctgtctctcttgaggggctgatagacacaataaaagtacagacttgagaagcagatgcaaacagcactagcacaattagcgaaatttagcatgacagtttctttagtgtaaagaatctgaacccagcacaaagtgaggccatggaccaaggacagaacatagtaaataaaaagagagttcttattatcttgaccagacaggagaaactgttgtgaggggaaaataaatctcgggatccccaaatcactaagccaagggaaaagtcaagctgggaacaatgtcagtcaaacctgcctcccattttatttctaaatacggtagctacaaagataagaagctacatacctccctcacaatttgcccacaaggaaataccttgtggacaaaggacagacagaactcaaagtcattcctctgaggctcacctgagacaaatgcatatctgattgcttcctctgccctctttgtttatataaaaatgcagattcactgagccagactaaattttgtattcagtggaaggctgatcaaagactcaaaagaatgcaaccttttgtctgttatctacttctaacctggaagcccccacttcgagttgtcctgccttacaggactgaagcagtgtacatcttacacatattgattgatgtctcatgtctctctaaaatgtataaaagcaagctgtactccaatcaccatgggtacatgtcatcaggacctactgaggctgtgtcacgggcgtgtccttaaccttggcaaaataaacttcctaaattgactgagatttgtctcagatattttgggttaacactgtctacctcacagtagactaataacagtggctacagaacaaatgtaacatgttggagatggatagatgataataccttgattgcaaaataatagttcctcctatagttaaagcaaaaaaaaaagtttcaaatgatgaaaatcaggcttcagtaaatacaatgagagtctgtgaagcatctgagggccagcatattttagggcagtatatttcaagcttcttcactcctattctactttcttcatgattttgccatgtgtaagccttaaaataccatgatagctgtaacacatattttacatttattgtttcatacagttagtacgaatggatttatcctgacaaaagcactagctttctgtccttagtaaagccactctactaattgtttaagctcatttgctcttcagttcattcaactaatatttattgaatgctttgtattttctaggatttgtctacctgatgtaggtggtaggtgggggtggagggaaaaagataagaagacagagatgagtagggcatggtacctgcctcagagggattcagaataaaatagtttcgcagtttcagattgttcatagaatgctgagaaagcaggattgagactttgcctggaggaggtgggaaactttatacaaagttgagcaggaaagtctagataaataagtaggaagagtttgttaagcttatttggaagattcatctttcctggatcttggccagattttttttaacttttctgaccatgaattaaaagacttcgagattttttatagtgttcagttcaatcttgtggttgtaatcaggaggttctcagattaagtttgtttaaccatcattttttgtaggtatggtaaatcaaataatagaaacagtataaccataactaatgaatattttggcatatagttcttacactcataatttagaatataggtgtgttgtgtgtaaatgtgtttccatttcacctgaatttctttgtacagattttacagaataaaatgccagttactttcttctactgtttatttttccttatgaaaacgttattacaaaaggtgatttatatgttacttacaacacgtatttaccacaactatttttgtttttgtgcttccagtgtaaaactctttctggagtctgtgaccacatcatatccctgtcgtcagatcctctggtttcacagtctgctcacctggaagtgattcaactggcaaacattaaaccaagcgaagggctggtaagagataccatgtttatcaaaaccaccatccatcagtagagagctaatgatgtggacaaagcagcctctgaatgtgggaatctatgaatttcaacagacactgaacattttggtatttttttcctggaggagttatggtagtggaagtttgtgatgcatgataagaagttttatgaagataaatgaaaatgaaggagaattgaaaatggtgacttctgaattaatttaatttggtactcatttagcttcaattacattctttcacctccctccctaccaaagttccttaggtttaaaggaagtttaagagttttataataaacaccacaatgttacctgctcatgaaagttggttttttgtttgtttgttttgtttgttttactttggtttgttctggttttaatagttattccttcccctagggtgggttagctaaacaaaactgatattctttataactcgcattcattcttagaagggtaagtaagcacgtggatattgccaacactagatgtctatgagttgtatttttttattatgtaataataaatataatcatgtttgatattttgttcacctgattaaaaagtgtattggttctagatttaacccaagagagagattttttaaaatataagtctataggaagaaagcatataaaaattgatattgagacagaaaacaagaaactggctagagaatatcttaactactacacaactattacatgttagtttggtgctatagtgtttccactttctccctgtatatgaatttaccaattaatgatattttggaaaatagaaatcttgacaactagcattaataattgaattcagataatatattctttaagatctctaagcaagtttaactttttctgtggcttttctttttcatacatctatataactgttcagaaggcaaagcctttattgactaccactgatttttcagtttgaggccatctatcctagagagtaagttttctgcagatatgtggcaaattaattctggttatctgtagttcctagtgctgttgtggcttttatgggtgttttcctgggaaggaatatgatgaaaatcagcatatcagacatagcatgccatcattgtgatctgtaagtgctatatctaatgttgattacatttagaacttctgttaagtaattataatctaaaatttttttattccttttagttacatctacaaagtccagttttatttttaaaacacttcaatctatagcaataaggattggcctttctatgtatccccttttagtagttataagggaaaggaagtcccctaagcatgatttttagagtgaaaaattatgaactaatacaacattgtattaaactagaagtcagaacacccagatacaaataacttacataaaatataactatgagagtgatcttgaagagatgggagagtaaatttaaccaccttggccttgatctagtcatgtaggtgagggagatgaggagatcatctttaaagctccttctggctcttagtctgtggttctaaaaagaaaaaagcctgactttttttctctaatttccactgaaatcattgggagaaataaccttgtaaaataagtcaaaacaatgctaattaatgggctttatgaaatcttgattttttaaggaaggtatagccctggacaggtcctttattgttttcatttgaaagaggtagatctgggaacttaaaatgctaagaaccagattcagttaaacagtttaggagagagctagaagagaaaagaaatgaatgcccatcacttgccaggtatttttctcacacctctatagagtagatattaattttctcattttgcaaatgagaaaataaaattgcacatattcaccagtttgctctgtatcacatatagacaataaataacagaggcagggtttaagtccaggtaaatctagatgaagtacatctgaacaaagctttttttactattccacattcaaattttgaattgctaaacaggtatgagaagcttaggaggatgactttaaaactgaaattacttagagaaatttgtttttaaaggacaaggggcagcacttcactgggaattgaaaggaaggaaaagaaaaactcaaaatgttgaatattaatagaaagagttaagtataaaactattttttgtgattcgtatcaaaggggaagtactaaacagagaatttacatggcttattcaaggtatcgttttaaaactcagtcacgtttaagtaagtttagtcagtcacatttgaaataaaccaattttaggattttgatttaggattttggtaattagccatagtaaatgtctaaatgataaatgaaggaaagaaatagaaagcggtgggagaataccaagatttaatgaaatttaattagcttagaaatatccacagaaggtgttcttccaatgttaggacagaacatgtctcataggcaaaaggtaactgatttgttctcctgctgataaactggatacatcgtttatcagctttctaattagtcaaatctcctagaatttcttaggtttaacagtcctaaagcattgtaaggactggtgagaaacaaccttagttatgattgaaccatatgaaactttcttctaaagtgcttttaaacaacaataattagcagaaaattaaaggaaggaaaatgagagctattgaaacaaccaaactggatcagagccaaggcatgagccaaatagagaggaagggactggggtcatccctggggaaacctcttggcctcagggagttctttttctatttgggtacttggaccatctccaaatatgccttattccaccaacttgactgagaggttgctttggctcctgttggttaaccaacatttggagacagagcaaagcaaatgtcattttggcaacctgagcaggagagagggagctgtgcaagtcagctctagaattaattaatgaatttttaagaagagagaaaaggaggaatgaaggttttgatgaaatggaaagccatatttgtcacggttccagaaaaagagtcatttgaattacatgtcctcctgctgtttggccctttctcagaggtgaacaatgaatcagatgtatttctctggaccctttcttattcagaagatgattagtttgaaactcatccaagcaacttatttcttctctttcttttggtgcctgacttttggccatttttctcattactactatgagagggagattaaaaaagacaaagaagtcagttttgattattaaaagcagttacaacatggtttattgagtttagaagtgaaaatattacataaaacaaaatatctttattcttgtggcatttaaaaatttgttttatttctaccctattgctttatgtctatatgtagatacatctctaagcatttaaaatttttattcatctgaaaaaaaatagctttaatataaattgtacaatgttgtcatgatgagatcctcttcctataactactagatactgtctttggcttacaattgtcagttaagttcctggtatttgtaataattatacacagataaatttagagtcatagctatgctgtttccatgattttttattatcccaataactacagtgtcttttctaaacatttttctttaaatattaggctttctttatgacctcatcatttatagaatcatttaggactcttgtcaaacacctttaattcgtagtcaatagtgaaagatacatggagaaaaatagaatcaacttctgcttacagttgtcaagatgttgacagctgttgtgaaacctcggttcttcttagtttaaaagaacttaaacaagagatacacagcaaaggagatgtagcatagagcaatttattgcaaaggaaaaagaatattgtgaaagttaggtgcagaatagccagtacaccctgagagaggattcagggcaggctgctcctgaggatgagaccgccaagactggcactagggagactccctttatgggagtcttacgtgattatttatatgggggtgggaagagctgttactagtaagcatgttctgggtggtcctctgggtgtgcacgtgcacagtagctgtacatgcctgttcatatgttgcatgtctctttagcatcttaaatctccacccagggctgtgctttttactattataatgagcaaaggcttagtttgaggacaggtaaaatcaaaatgcacgtgctccctccgggggaaatttcctagctgtgcttgaatgagcttgactacattgtgaatgctggggcttattgtgttaaccatacattcgccacagttgccaaattccaaggacatgttaattccttgactacctatcctgcctcaaagagagatgggtaattgaaatgaatttgtaaaatatcaatcccagttattcttttagctacatttcatatactacatatttgctaaagtggtcttagtcttttagaacagatattaaaaagtgaatgtttgactttaatatctacagtcatcaaatattctaataagaaaagttaaggtgtacaactctcctaactgtaaataaagccataaatcaggagcccagtggttgagagtgtggactctggagtcagactgcctgggcttgaaagctggcttcaccaccttgggcagactccccagcctctctgtgcctcagtttccttatctctaaaacagagataatgatagtttccactacatagactattgtgaaataagtgcaagacacttaaaacagtccctggcacattgtaacaagtagatattaatggtggtgatagataatgatggatgataattattttgtgtgtccgaacagtgtattttgttttgttcactttttccactttatcctctcacaacccttatatgtcaaaaactaaaaattggccaggcaccgtggcttatgtctataatcccagcagcgtgagaggccaaggcaggcagatcacctgaggtcaggagttctagaccagcctggccaacatggtaaaacccgtctttactaaaaatacaaaaattagctgggcgtggtggtgagcgcctgtaatcccagctactcgggaggctgaggcaggagaatcacttgaacccgggaggcagaggttgcagtgagccgagattctgccactgcactccagcctgggggacgaaagtgaagctccgtctcaaaaaaaaaaaaaaaaaaaaaaaaaaaaaaaaaaaaaaacacgaaaaatttactctctagctcttacaaatgtgcagtcatgcttcatttaatgacgggattccattccgagaaatgcatccttaggtaatttcatcattatgtgaacaccatagaatgtacttacacaaacctagatagtacagcctactacaaacctaggctagatgatagagcctattgctcctagtctacaaacctgtatagcatgttactgtactgaatactgtaggcaattgtgacacagtgttaagtatctgtgtatctaaacatatctaaacatggaaaaggtacaataaaaatatcattacataattatatgggaccaccatcgtatatatagttcactattaaccaggacgtcattatgcatcacatgactgtattttaagatcctttattaatctgatataatattgttaattcctgaatgaaaaatatttacagagatcttgtcctcttctaagttctaaaataataccattatatttaccgatcagtaaataatggggtaaatgttagcttcaaattaagtatgttgtatacctgtcaccagtgtaaggctgaatattaccatgttgtcataggcaaaaactactggccaatccattaattaaattctgattgtacttttgttaaggttatttgttttatataaagtgataagcattcattttgtttcatattagcaatccaggctcagccattttagacatatggtattactgaaatgactttttagaattaaaatctacccagtgatttctcaatagttccataccatgaaatttactacttatttttctaatctcttattttcagtgaagacacatgtattttcaggtatctaaatatataattaacaaaggtataggaaattaacattgtagcaattgcttcatgtaagtactaaatgtatgctttttctgaaatggtattgttggttgttattattaaatctatatttcagatttgaagttaattaatattaatatttttatttatgaagtaagtattttgaaatgcaaaccacttttataggtaaaatttgggtagtttttccccgaaaataaatttaaagtaacaatcttctttggaggggacaaaaattcattaactgaatcatctagtttgttctgatttacttaaattatttaatattaaaaatgtgaatcccttattgtgattttttttctttaaagttccatcactatccataatttaaagtttccacttgctcttaaagtttgtatgatttcaggatttctgtataatttttaaactttaatgtagttttttctaaaaatggttctatttaaatggaaagtggaatcttgtcctttttactgggggaagggattgctacagatacacactaccttttaattatcgatgtagatatgattggatataattagtaaaactttatcaataagaaaggtggaaaatacaggatactacaaaatagaaggagaaaatttatgtaaattatattttatcactcttctggttccagttataattgaagtgtctcattagaaaactactttccattgtataatatatcaagtataataagttaataacataccaatattttaatttcccattgtaacttttattttgccacagaatatgcagtatgggtttttggggagagtgagagagtttctttcttaggaatattgaattaccatgctgcattttatcagtctcacaggcaattcacttatcaagtagttatttaattgagtataggcttcttcagacaaactttagaaaccagaatgttcagatagtaatttctcaccagtttaaagatagcgtctgtcttcatggatttatttctggggcgtgtggcagttttaatttgatagagtaattttttatataaacgaggttacaatgtacttgaaaattcaccaattgcttcactttcttttctgatgctgtctttttcttagggtatgtatattaaatctacatatgatggcctccatgtaattactggaaccacagaaaatgtaagtattctaacctttcaaatttttaagtgtgtttttcccttttattgctaacaacttatatatctcacatgattgaggttaacatctaaggataaggacatgaacagatagtagatacaatttaaaagagatactgagttagtagcattcattctgttcaaatttccctttttttttgtttagaatagctgtttacttaaagtaaatcaggtgttttcagccagagatttgtctttgtattttctgattcatgacaagttattgtgacatctgaaagaattcatttccatctgtcaaatgatttggttatttaaagaaactaaactcatgcgagaaataaatatcagataagtcaggttttctgaatacttccagtataattcagcttaattcagtggaagggcagcatggtatagctgagtggttttcacagtgacattcctggacaccagcattagcctccctttggaacttgctatatatgcaaactgttaggccctaccccagacctactaaatcagaaattctggagaccagcctatttcttaataagagattctattttaacaagtgaatctgaggcatatttgcgaaccaccataagcagtgggccagaagtccacaggcctatgtctttacaaccagttctgcatcttaatggcagtgtaattttgggcaagacatttaacctctcattgcttcagtttcttcgactataattggaaacaaattatctgcactacatacctcactaggttgtaatgaaaattaaataagctaagaaaaggccatgctatagagaactatctgtgttatagagagaaaagcatgaagtgatcatgctggatattattaacatgatcagtgtgatagaggtgaacagcataatacatcatcattcttgcatttggttatttcagatttccattctattattatataagcaggtactgagctttgaatgtattttttttttattttagagattctgccaattgcatgcatatgcagtgctcttttaaagaagactgaggtggaattagttcaatctcaaattattattgatctgaacattttaccagcattttctttttaaaaatcaacattcttttcatctaattcccctatgtaatcacttactgatatttttccttgcttctcttggtttcttgtgaaaggtgaaacatatatatttgcagttggagtgcaggagcagcttcacatttggtattaaatatgagagtcgtagggatcaagaatatcagtaacatgcatattatgaagattttaacaattttaaatgcagttaagatgctacaaactatatgcttgtcatcaattgttcattctgatttatttattcattcatgtattcatttgttcatttaacagacctctgcttcatgtctgctatgtttcaggcatggtgctaggtattggaagaattttaaaataactagtttggtgccatcaaggcgtggagagcatgtgggggttcatctttataaacagtagtgtaatttgcatggatggacaaagggaagaatagtaaatactgccaagtgaaatcagagaaagaatcacagaaatggttattttgaactgtatcttgaagaattggtaggaatggatctctatattgtctcaggtctgcaaaaaaatgtggagcactgtcttgctcatattactcactaatgtttcataaatagataagtgatcaaaagagagattgagtctgggagtagttcagatatgaaccatatattaatagttcatcttttgattcttttttttcttaaaaatatttaagtatttttggtaacctcagtcatttataattaggagatctgtcttgagtcttagtaaagctgctcactagagtgggtaagttattttgctttgctgtgccctaatttcttagttttcttatatgtgaaatgaggcatttggacaaaattctatctctaggatctcttttaaaactaaaaatctataatttatatgacttctttacttacctgtgcaaaatgtttcagtttctttgaattttatatactatcattttcttctacataatgactagagccatttgctcgatattttttccatactttcctttaaaaggatcagttgtgaaccaaataccacaggaaccaactatagttacaaatatattaatgatttacaatcttttcagaattgtttcatggtacttgtctgacttggtaatatgtccccctcctaaaggtgctgtgagattaaaatattatattattgttatgactctattcttagagttttttattgtagattgatctatccccttaataatgtaattgtgttattacttcagtaactagaactccctggtatgttgtcttatcttgaattatagcctatgacaaataattttattgtgaattttaaaaatgtgttgaatggaggttaacattgtttcaagacttctatgttttaaaaataattggaaatgaataaaaaacaaactggaaatcacttttaaagtatgtcctactccagggtctcaaaagtagcattgtactttgcagattacattaccatattcttcttctttagctttcagtagataataacgaagagtatcacagcatttatgtttgtgtgtgatagataaacacatacacatctatctagacaaatacatttttataaaaatggattttctatatattcaaaagcatattaaaatgcatataatcaataagtagctaacaagaaaaatataatattttaaattcattactcagacctgcaatataaaatttctatcttaaatctcattttaatttcctaaaaactccttaaaacttgtcagtattagcttaccaagtttgtttgtttttgtttttcatcccttttgggaataaaggaaaaaagtgttagattattgcattctatagaaatattggcattttagttcattgaatgtggttttactgtccagtgtattacactatatgtaacatgagaaatagcatcctcttataactagacacttagcatgttatgtaatatgatttgaactaattgctgtccatcttttaatttgctttgctagattattcagaattggtgttactgatgaaataaattagcaatttaattatcaaacttcaaatctttgatgctgatcatattcatgtacttgaaatggatttgttgaagttaatgtgaattatttatatcaaatggaaaggatcacaatacaaaaagatataattttttgaaatgcatttttgaagcacttacccactagagcctaggagagttgcttgtataaagtttacaaaggttaataccaattatcattttttcataatgctctcagaaacgtgttcttttataataaatatctatatattattttgcatttctgtttgttgtcattagctatgcatagaatgcaaactattttttattaatttttttctttctatgtttatttaactggctcagcaggtaaaaacagtgtattaaatactaataaccgtgtttattgctttaattccttgaaatttttaattaatttttaaatctaatttatggagatgaactttttgtagtgtttccagagacaggaaatgactgataaaatttatgttctttatcgtttcttttatattaaattcagtcacctgcagatcggtgcaagaaaatccatgctggcgatgaagtgattcaagttaatcatcagactgtggtatgtataattaacttaagagtcagtgggaggaactaattttgatttgctaaagctttaaaagaatgccaatgaaatgaaattcctgtttgtatacaaaatattgaacagccttttgaaaaaataactgaatatttattcttcttaattatttgatggaacgtaaagcatttttttaaaagaacctgaagagcattggtggtggttgaggttagatatacatttctgtatggaaaagtactagataatagtatatattccatgaactggaataacaattttggaatagaaattaaagtgacagtatgtataaattcaaccttttcttgatacaactttttgaaagtttcattttataaattattgaattacctagtagatgttttataacagcatacatccatttatctaacattgatttgttcattaaagtatctggtggttttggggggagtattttaaatgtagatctttgaaaattttaaaatttttaatagctgaattagctttttatttcctaaaagaggacaacagttttcattttaaaaaatgttcttgccctatgaacctcacaaatccctttgttatctacccttaaaaatctacagtaggcacagaatcccactgccattttttataatagtgggattctgtgcctattgtagatttttaagggttatttttcttaaacttaggtttagaaaatgaacattatatgcttttcattttggactattttatatgtctcagttgattcacttttttccactctctctgccaaaataaagtatatttgttatcttaaaaagttaaaataatccaaaattattaatatcataactcatttgaaaaaaggcagagtttttattagtattctgctcctcgcttactaactcatcagagtgagtaattatttcctattacacaatttaactaaatttgcttttgcatgtcctagtgatggaagaaattttgtgaaaaacctgatttttctcagtgattctaatcataaggcaaatgacatttcaattttggttttgaataatttgagaagtctgtgatattttggaaaggctcctagacactgataattaaagccatgatgtctcttcaataagttcattatctaagtgaagtaaaagttggtaaacgttttcaaaattaaatgcgtgggtgtacctttgacactgaataatagagtgttggtagtagacaaagcctttccacactatgacagttttgatggctttcttttctgattactagaaactgtacaaagtagttgttctgactgaagtttcctgtcccataggatgaggatttgggcagtgggataaagcagctgcttcagtagacgagtagcttttccctcttctaatgtttatgctgcttccatttctgcaatgtgaccttaacaaacatgacatctgttgaatagtttcagcatgcatttccagatggtcattaagaggatagagattagtctctaataaaaataaaattatttaaaggatattgtttgtggaacaaagatactggtgtttatgaaatgaatatgaaagcctttgaaagtctacaaataaactaataaaatctatgtggattggtgacatttaaatacacctagaatgtgtaaatgcatctttacatcacaggaatattctaaaatattgaaaactacacagaatgatctttgggaaaacttggttccagctcttgctctgaaattgacttatggctttaagtgagtcatggtaactgtgcatctgtttacctttttctaatgataataaccatagctaacacttattgtgttcttacagtgtgccaagcatcatgttaagtattttacatattttatttcatttagtccatgcaataatcctgcaaataaggtatatgtagaaattgagactcagaataattattcagctcacccaaaactcaaagttctttgactctaagacccatgttcttacttcaattttattatactccctcccaaaactcaaaaattatataactatccaacaaaagaggaagaatcctaacaagcatgtaagtaaatctcaggattcaatgaaagattaagtggggccaaggtaggagaagaagaaaggaagtgagaatttacatagctgggatagcgagccagctgaactgaaattagaaatagggttgaaacttaactttactgccacttcctcactctgcttctttcactcagataagtaagatatgtaaaaacacctgtcataatgccgggcacacattaggagctcaataacaactttgcaaccgcctttcttctcttttacctgctacaacagttggaccaattggaatcctccttcttggcatactgctactagagccaacaaattgattttggaatataatagagacaagatagtatgttgaatttcatgaaagtagacttttttaataatatgatcggttgccaggtttttttgtgttcaagtagaggcatatttgggcaaaaccaatgcatttcactaaatgtagcctactctgccctctttttcttgctgttgcctgtattgtggtctgtacagtgcatttaatctcttattagataatatacagaggtggtgaaatggaaattctcttaattgaagcaagtataaattatttatagtctgcaattatcccttctctccctacgttcattaccatagggtttggttatgatataatagttacattaaagtatggcctaataaatttgaaatacataactaatattaattctctaatccattaattgactagaatagtgagattgccagtattgttccataccaatttagactcattaatgaaaagaacaatgttaaatcttataattttggatgatactaacccagttagtatttttctgtaattctaaaatttcctatgactataggtagtaatgtaaaatataaaatctgatatttttctttacttaagataaatacaaaaattattttaaatatttccctaagagtctaagaaagttgaataaatcagatgaattcaaatactatttttttaaattgctagtatggtatatcttcaagatgtctaattagatgcctatgtttctagtttgctccttttttaaaagtattttcttaattgaaatgaaactggaagttttatgtcctttttcatgttgctatattctctgttataagtggcttttaagtttttcaaaccaacatacttctgtggctgagaaactgtggctgccagataggaagaagaaaaaatcatgaacatccaagcaaagcagactgagtcttattacatgtcttccccaccattgaagatccaactcctcaaaggctgctggaatctcccaagattttttccacttcatctgccactacatccctctctctgggagatacctcggcatagtttgatgcagcaactctgccctcatgatgcacttttaacacatttttttagctgatgagactacttatagttattaaaattattggggcatatttataatctgttcaatttcatgttaatactgtttttggtgtgcaaagggttctaaagattctatccatactaaaaacagtctcgggaatatcacttgagaagagtggcatatatgatggttgaatctattaacaacatttggaagtttttccttttattttgtattaatattaaaacatattcactgttattttgaaagatattctggaacctgatgactacattatggaaagaaatgtttcaatagatgaggctataaaggatactggaatggaaaataaccaggttgggatagtcaagaagaagatagactgcagcaaataggatgttctacattgattagtgagagatggaagataagtactataagctagtggtttttgttacctccaaaatgataaacattgttgagcaagactaaggatggcagagagtgtgggaggagggaacagattgaaggactatctcaaaacttcctctaacttcatttatgcgtctcccttactctcactgttgtctctcattttggactctgtcctcactctcttgttccttcaaccccagaacaacaggagaatattgttcaaaggagaagccaacataatcagaatggatagagagtgtggtatccccttaatattcatctctccttttccctccctctcaatttacctccttccctggacttcagcagaaatgaatgagtcattgagtggaatcaataccatgatattgtctaacagcagatgtactttctttctcttttttgatttgctaaattgttgtctttatttttttggtttttttctaattccattttcttttctttatcattctcatctcttctcactggactatttctcctccactcttcatctcattaagttttctttgttcttccctattttcttctgttctgctttctcagaggagaaagtatttatcatataattccatatacctaagatactgaaaactgagaccacaagaggcagtgtttctggtgtaccccacatcttattcctgtaaacacacatgttgctggactacagagattaattatgttagcatggtgtttaacatattgcttaataaataatgggttcttataatagcctaaaataactatgttaggattctgtgaaatcagtattctaaaatagaacaagtgaatcattctcttttgggagggggaaaaattatgaagagacatataccaaaaattaaggaaatgatgcatcaatgattttagttactcataataatattttatttcagattctaccttatgtagtggtttatgagagcttcatagattgtttttcttttatttcacattgaacattatggatttgatgagaatgtgtggaaactggttttgaagtgatacgtattgatataaactgtatttttattttgtacagagaaatcaatttattactttatcatccaatataatatttcatgtttctgttatcaaactaaaatttattatcttaagtccttatataaaggagataaattgtatgatatctcaataatagttacttcctgttaaccaatttattttctctgcagatctctgcatcctgatttgtttctttcttatttgtgcagttcttactagctttaccaggaagagtagttgcttttttaaaatggttactgtttcattttttatgattaaactttatctttcagtgtcaacgtggttactatgatctagttattttacatggaatttttagtttccttataagtttatttcatgtgtttaaaatgtatctattggctgaagttcttacctactctggcttattaacttattaagtgtatggctcatttgcaaatcagcatcatcctcagtcaccccccacccgttttttttttttatctctttcataaaaggaagagtctgccagtcacaattgcccaatccacttccttttcatattaggagtaggcaatcagtagataacatttaactgcctgataaaaaattatcacatgaaagggaaacgctaaagaaccaccatataataggaaattaaatagatgatggcattaatcttaagttctttttagtttatttagccctaggactcaaggataggtttcatccactaaattaatattctgattggcatggtagctcaaattgtaggtaacatagccactcattacttttacatttcctctcacactgtcccttctgcatcttattatcctaatagtggacaataaaggatttttaaaagttggaaaaatggtatatagaattcactatggtctcatatggagctgacattgagttcctttttttgtctgagttgctggaattttggtaaagtgatttctaaaggtaacttccacagtgaaaatacagccattacagaagtttttcttactaaaaattctattaataaagatttaggatgatacttttagctatatatatatacgtgtgtgctttagttttgtgttgtgataaatatatacatatattgcagtatttgctaaattttcaaataagcatatttttgttacatgtctgctagtaaatgacattgtaaaaatcatttatagcaaagttgtacatttttaaacatattactttttgaatactagggtttgagttgctttttaattttgtcatttaagttcctgaattaaatttaagcatgaattttttgtaagtatagattttccacaaaattattataaatgggagctttaacattttagataaggatgcttcattttactccttagctttggtgactgggagtcttttctttttatttcaaaatacatatttttccagcatctttgtaagaagaacagaaatgaaatataggaaggaatggctgaaatttaataacttaataacccatgtaaatatcttcataaaaaaattagttaaaggcctgtattgtggctgagggcggtggctcatgcctgtaattccagcactttggtaggccagggtggagggggattgcttgaggctagaagttcaagaccagcctgggcaacatagcgagaccacgtctctacagaaaatttttaaaaattagccaagtgtcgcagcatgtgtttgtagttcaaactactcaggaggctgaggcaggaagatcacttgagcctagaaattcaaggttgcagagggctatgatcgtgccactgcactccagcctgggcaacagagtgagactctgtctcaaaaaaagaaaaacctgtattattatggttattttaaaatatgttactgctcttttggggactgaggttctacagtatgatcagaggtttacattacagctttacctttcactacaatgtaattgtcttcctccttttctctctttagcaaaagctttcagacccattcagttttatgttttgatgaagtaaaaggacattgtgaatgatgctgaaataaaaacaaaattggcttttagttttctgtagcatatatgaatgaaaaccatgaaacctccgaaataaaccttaagccttgaaagaccacagcattaccaaatgccatattggaaggggagaaggaaaagtgagctgtatgttcaagatgctgaactatacccacagctttggaatcagcttatcacaaaagtcaagacaccaactatacaaagtccgcagttaatataagtgataggttacaggagatagtgcaagtaacagggtatggaaagtcaccacctttggtaaaactatgtgggtgattcataaaacttacatgaaaaattattatcactattttctttctcccatgaacttcgttatgagtcaatcaagaaattctgatttagctctcagaacttcttgaatgtggggcaaaaagattccaggggagaaaaagtgctagcttcttgtagtgtttgagttgcctctctctcttggactctctgtccatctttagctgtgagaaattatgttctctgttagtgctttctttttaaatactacatatttatacacacacattatatatgcacacatattcataactgtgaaattcacattaagatattaagtattaaaaaagatatatgtaaattcagattgttagcagctcaacatggtctaagttttactttgaaattaagccacgttaaaaaaccaaatgccttgatgtactcttatttcactggataagtgccatttaaagttcaggaggatgtgagatgaagaatggctcaatgaataaagacattaaattgtcggctttttttctctaatgaaaataaaatctttcccgtatttcttcttttcaaatgtttgttccttttatcttttcccaagactttcttcgaatcatgtttataaaaatatcaacactaaagttttatttaaaataggtaaaccttgggacatttctgaatactctgaattacctatttaagttactctaagctagggttaaaaatcacttatttgcatagttccttaaccactgcatacacattagcttatattcctttgtacctgaaccatgactaattctttatttctgttcagtgaataaatgactgtgaaagaacaaaattaagatatctccaaatgtagtagactttaatattgtaagactttttttattaatatttcatgggaaaaaattaggtgaagatggatttcgtagattggtactcattatttaatagttttagaatctttgaaaggcactgtatatcaaaattcattatttctgaaatgtttataacagtatgctatttccttcacatagattgttttcccaaagaaagaggtagtcattggtataaaatgtttaatttattagatacttcagtatctttttagtaacacaaagaaacagaacattataataaatatgtcagcaccaaaaaatttggcaaagactgagtgtcattagtggcagtatgatggcttgtgtgttgaattaagtctcttcagtgctcttaaaaagagcaggaggatatttgggtgtagcatgactcatattaccagacattcatataggcatacttctagtctataaaatttcctttgggaaaaggtatcatctacattacatcctgtgagtaagagtgtgtgtatacacaggagtgtgtgtaaatgttgataatgaatctgtttctttgtcttgtgtagggtaataactttgaaaatattttaagaaatgttctatcttcctgcctgtgggtgtaaagatgctctcttgcaactccaaatatagccatgaaaaaaggtaaaaaaaaaggtctgggttgataggcttaaattcttacctttatgtttatttgtaactggctacttgggaccatagagtagaaattatcttttcatatgttagtcaaataactcaccagctgttatttggaaagcagaccagggcaagttctaaaggggtcagagacaacttcttccctctatgtactgaggggaaaagaagcctatcatctcttcagcaccaaccccaaagcctcttgtgcacctaatccaggcaaccaattttccaggacctgcccacttatgttgtccttcacaaaggaacacctgctgtctgcttcagcctgatcaaaacaattacaagccccatccacaagaaagcagaacctctggcttttagcacttgggattccttaatgaccttcttgggaaattttaatcctgtttatgttgtgtgtaaaatacattttaatgtacatgttggggattatatataaattagtaagctatatgacttgctgttgcttgtaggcactgacttctgctaccttggataatgaagaagataatagtagttcagtgtatgtgaaaaacattatagctaataataagacatttgtgtaaaaatgcatatggtggttttataaaggttcattttagcccatgaaattaatgtgaatgaattactctattaaaatattgataaagcactacaaaatatttttctggaaaaaacaccttcataacagtgtttatatgatgcatatgataaagtaaaatttttccaggacaaataggatctatacccactgttcttttccttgttttaatcacatcattatgactttaggtctggagtattcaagatagaaatgttttttcaaaggttcatttataaggagaaagtttatttgaaattttgaggtacagaatgtctattacagctttagtatcaagtattttacttttttggatgagaggtcatttaatcttttatgcgacaaattttaagtatattacatataaaaaatattttaatactatatcttggttttatgtacaaaactaaaccctcctttcgagtttcaaggccctttattgtctctgaaacatttacatcatcatgtcaccatatcagctcactagtcaagttatgcagtatgccgtgagattcacatgaggaaaatatggtgtcacctttaagaagaggctttatgatgggtactgcatgtaagatgaacctttatggataggtaagattttataagtgagagaaaaattacaagcagagggaagagtggttttgcaaagatacagctaaagagaaaagcacagtgtttgaaggaaacgtatattcattactcaaccaactcttttaattatcaactttctaaaagcctcttataatcatctgaactctgtgtgtttctcctgcctcattactccttcccttgttctgtcatctacgtgtactgaactactgaaagttgctcaaacctgtgatactttgcctcagagctttgtttaccccctcaacctccacatcttcttcacctgtccaactcccaaggaatttggcttaaactcattggaaaccttcattagaccctcaaggatgggttaggtgcccctgttgggggctcctgttgcactctgtattcaccctattgaggtacttatcttactgcattgtaactgtttattgctccttaatgaggtacagactgtgctgcattcactgttgtattcatactacatggaagacacacaataaatacttaagagttgtcttaaaaacatatgaaacacctaaactaatctagacatgagcaagtcactgccttcaaggagctcataatctattacagaggttctcaaattgtggctctttaggccagtaatatcagcctcacttggaaacttgtattaggaaataaagggtcgggggaggaattctcaggccccactccagaactactggatcaaaaactctgggggttaaaactcagcattcttttaacaaggcttcaaggtgattctaacacatgctaaagtttgagaaccacattgaagaaaagtaatctgagaaaaagctgtgatcaactataccgacaaaggacctgtttgaggattggttatttgttccttagttgggcctttggagagctattaaaggttttgaagcatagaaaacttctacactgtagcagtattttggagctgcaaaagactagaagcagaaagacaggttaggattctggtttaagtctagcagtaggtatccaagccagaactaaggcagtgagaagaggcattagttgctaggatctatttgttaggacacaaaatagattaaaaagaggagaaaagtcataggtgactccaaactcccgactttagaggatgatagggaggtttttttgttttgttttgttttgttttctggtgaatgaaagtaaagagataatgagtttgatttttaaagtcttgtattcatgtaagctaccagtggatattcaagggaagatactgtgctttagaattgaaaagacattaatgtaagttctggcttcaccacttactatttttgtaatcttggccgagaaaacaatctctttttgcttcagtttctacacacgtaaattgggtttaatagtttacctcattaggcttttgtaagaatgaaaatataaataaaaagaatgtaacatagatatgaagaatctagcacagtgaattgttgatgcttgcgattattcggtagctattaacgtggacaagctaaacagttggaaatatgactagagttattgataggaagcaggaatggtagaaagatttgggaatcatgcaggaagctgttggtgaaagctcttaaaagagattattgtaagaagacagcatgaaatattagaaagatgtgtaacacttagcctagaggaaacaggtacacttattggtagggaagaggaagaaaagatggaggacaggtaggcagagatgtaacggaaccatgttattttactcaaactaatctttgtcatctattttcatgtttctacccactctatgttttagagttggaatgtattgtgactgaaagttacctaattatttgacctatgcaagaatattgaaacatctcttggtattgatctatttcacaagtcagccaatttcttttttggatatctttttctattagaatatttttcatctctggacgtggtggttcatgcctgtaatcccagaactttgggaggccaagatggggaaattgcttgaacccaggagttagagcccagccctggcaacatagtgagacttataaaatcttgacttattgagtacacctgaataataaatttatattctctcttgtcaatcatcaaggtataatgcatagagcagattttgtttctccatcaccaccttttagtgttttaaatagtagtgttgcctttctggttctgcagttttggtggaaattttccatccataacaaacagtcctgattaggtaattcataaaatttattattttctaattggaatattgctattcatacactaggttcatgtattttgttggtttatttgtttgtttagaagagtaactcatgcttattgccaaaagtttaggaaataaaagtataaagaagaaagtatgtattgcaagtccttactccctttaatctaaccaccattaatggtgttttctatatttatgtacattctttaacaaaagtggaataaaattatgtttgctattttggaacttacttttttcacacaatttttatatcccttactaatggatacatttacataatgtacaggttttggttgatttaaacaatactgtgacacatatgttgcacatttatttttgtgcttttatccaatcatttccttatggtagtggaagtagaatttgggagccaaagatatatactatacagttttgatgtatatttctttgctcttgtttaaaacattgttaatgtcatgtgaataataaaaggctgatttaaaaatagtaaaattagatacccaaattttctgccattaaataacatcagctgtaaaattaaaatccacccaaatgaactttcttgtcagaaaccaattctactttctgatagaaaagcaattctgttttttggaattgttacttaaaaagagcatgtagaaagtgtgaaagaataggatgaatcaaattgcactgaaaatttcacaggaaaataccatctagccttaaaaatcttcaaattttataataagtaaaatgaaaagaaattggtgagtagaaatcaatgtataaatcattgagaatagttatgctggaaaaaagattgtggccatcacattgaccactttagttagcaattatttgagtgaataattaagttacaaaatgtggttatcattaataagttgttcctaaactctttgtataagtagtatgttttctccctccaaacttgtaattcaaagtgtgcattcatatttttttggcaagcaaaatgaacccttggatttgaactccctttgctttaactcttggctgtagggatactacacagctatcagaggaatcggaatcaatgtaatatacctttgggcacataatagtccccacttacatataaggggaggcatttgaccagttccattactgtagttgatccacattaatgtgatttaaaaaaaaaaactggcagtctcattcaggttatccaagtataatgatcattttgattcatatctgagactccctgagattttaagtattataacatctcacttcttgtttgttctaacttcaccaacactcaattcagctatagttgaggttgcaatttagatgaatgcttattaaatataccaaagtccccattctataatagctgaattccagattacctcttcttcatagcctaggggtctgtgctgcttttggtggaagtgctcattctctccagcttgacaaatatcttccaggcaaaaacatggttattattagacaaagggcaccaattatctttaacttggatgcctagaaagaaactgttatcactgttgagaccatttgctaaatcctgcttacaatccaggataaattttgacctagtgtatttatgtaacacatcctggaaaagtataatccattagggtttgggataaaaggttcttctctcttctaaatgtgaattttttttaaaaaaaacttggaataatagacattttaatgtgtttctttaaagcatagtttctaggatttcagttacctgatactgcatcactagtccgttttgaaagcaaagtaacaaaaattattctatgttcagaatttttaaaggatgaagagtgaagtaattttaacaggggatgcagttgagcccgatttcaagacatttatcaagtactttgatttaattacacaatatgtttttaggtgatattcaaatagaatggcttcattaaatttagcacgttatattttaagtttatagggttgtttggaacacattccaatagctgcttcattggagtagtattatcttgttatttttgttctatctttatagcatggtaaaaggtttattgtattgctgctattgtccatgcgtaagaatgttgccttggtgtgtcagtaccagctattggtagtaaaatatcagtctaatttagagacactggtaccacttatctctaaaagatggtgatgagaaagcatgtggtgtagtttgtaagctcaggacattgccaaatccttgttttcaggcatatagattttttaactgtacttgtgaacagagcttggatctagacctagcagctgagcagcattaatggtgacataatttcattacattctgaattactccattggtaggataccattttagtctttgatttgacatggtaaatgtccattatgttgtctggtaatgatatggactaatgcaataatatggttaatcaattcaaagataaaatttattgagtatgtatctcctgaaaattgataggatggtacaccaattatgtgacttttttttttactaatcttattaaagggggagaacattaaatctttgaatactgtacctcaattttattgtaatgattttgctggttaccaggtggggtggcagttgaaaaatttggtgaatgcactacgagaggacccgagtggtgttatcttaactttgaaaaagcgacctcagagcatgcttacctcagcaccagctttactgaaaaatatgagatggaagccccttgctctgcaggtaatgaagcttaatcataagtcatacaccatcattttagccatagattatctcagtaatgcttctttattgtgcctcatctcagcagcatatggattaatcttgtatgcttttgaaaagttgtttgtgaaatgatctcttcacagctattctaataggcttaattgtgatgaaatccttgagtatctaaaacccaaatgaaaaacaactctgccttaatttgtaaacatttaaagcataattccaaaatgtcacaatttatttcatgccaaaatatggatagaatgaaaataagatggttcgtttttatgatatgatcttctattttatgttatacccacatactcttttagaagaagctaaatgatagtttatagaattcttttaaatcagttcataaaatagtaatagtaatttataaacagtaggaaaatgaaatgttatattagtaattaaaatgcacctagtccaaactaggcgcagtggctcacacctgtaatcccagcactttaggaggctgaggtgggtggatcacttcaggccaggagttcaagaccaccctgggcaacatagcaaaaccccatctgtacaaaaaattaaaaacttagccgggcatggtggtatgcgcctgtagtcccagctatgtgggaggctgaggcaggaggatcatgtaagcccaggagtatgaggctgtagtgagctctgatcatgctactgcactccagcttgggcaacagagactccatctcttaaaaaaaaatgtaccttgtacattcctcctgattgatcatttttctctttccaccctgtaaggtggcaaaaatagggaaattgttgcactagaatttttgcatttttcttcagcatgaaacatcactcttcagcatgaaacgttactcttaacattgataatatatttattgagttatcttgaaagttataaaaatatgattctgattgatgaaaggcaaggatgtaatgattttttttctatttcagtcaggatataatctttaaacttaagtaatttttgtccttcacgaaacgtacattttaaaaataagagactattaccttttcttagaagttaattaaaaaaaaataggcccattgaactggaacatggcccattattcatattaaaaaggaaagcagtatatgaaatgcattgttgtcactgctatgtaaattgttattaagctctatgttagtaccttttattattcatagattttttttcctaagaatcaaaattctccattatacatgaatggctttatagattataatgatttttcattgtttaaaactttactacttattggccgttggcattatacttaatataaaaacacatatatgtgtcaacattatggcctttaaaattttaatgtgaatctatttttcaagttaatatatgtaaaactgtattaatatgtccaaatccatttgacttgcatatatgtttattttaaaagatacttgatgatcattacagttcagaggtcaatgtttgcctcattatctaagtcatagatgagtagatcagactttcccattacattattttttttcactgcattataatttgctttgctccccctagagtttcctattgccatgtcttccctaaagatccttcttcaaagtgtaagggtgtgggaaccctgaaaaagaggcctgtattttcagccagtaggttttcttctctgtatatgtgagtgaaatttaatacctcttctttagtccctcatatttcacattaagcaccaaaaataccctagtttcttgttgatccatgcactcggtttgagggaatatctctagcacatgcttttataatctattcccctgttatattcttttccacatgcacaaactgaagtggagagttaaggtaatggcagtacccagttaagaatcattttcatataaaatgctaaaataattgaaagaccaacttttttgttacatatacattgggtgtaggtattcaaacctagagaaaaaggactttaattttaaaaattacgtcatgtcattccttaccctgtaagtgccttactcttcaggcactatttctagatccattccaaattctgagaaatgtgcctcatcagatcactaattatttttatttgtcatcgcttattcagctatgctgcatgtatttgtaaatttactttttcaaaatgctgaaatctgaaaaagaggaaatcagcattatataagtgctgtatatattgacatttttctaaatttgtcatttcagctgaatttggttcaactaaaagctattggccaaagtcaaccatccgtagataaataatactattggttgggggaggggagactgcttctaacatttttgaaaattacttcagttgttgcctttttacagagcagaggaaagagtattggtgttaattaaatattttctagtggctaaaacaaggtcttaggagtgaggacaatgggtaagtcctctaacataccgcaccactaccgaatctccctgatgaagaagacctgaaattgaaccattacagaattcttcattgatcttaaagttctggcttatgctaaaatgcaaagacacctgaaagcataatgaaaactagtcaaaatttttatagattatagattttggtacagaagatggacaaaatctcaaggtaccaggatctggagggtgaaggtacactgcctccagagcaggaaaagttaaagaaatagtgagatgaaaagatcttgaaggcagtttttcataacatcatgactttatctgaggtcaccttttcttcatagtacctaaggagctacctcagatgtgaaacgtaactgctaaatgtagtaacaatcctctacatagacaggagtgccatttttattgtattcttccttctggtaggtgcagaaatacactggagccaaaatgcccatcagctcatccaaatacaaatcttcagcattcaaacttgaaaaaatggaaatgaggttatttcttttttcatagggtgtaccagtagtctaccaagaattatttagaatagaggatacaaaaggaaataatctgtggcgtttatttaactcaatatgtctatttaacctttttgaaaatactatcccaggcttaatttacctgatagcatttatagattaaaatataggaaagtttgtagtagtatggaggtaggcactgatacatgtatctttttaataaacaagtttatcctaacataaggaataatgattttttaaacttataaggaatcgtttttatctatacaaataaaacaaccttatctatcctaagatagaagattgtcaaagaataccacgttttaattaaagtagtagttttatttctaaaaatactaaaagcatagtgacttccaatattgattaactacaatgatgaattttgatttggattttcttttgaaattcattgatgaaattatagccaaataaacagaagcatacaattcaacttcatgctcacagagcaatttcattagtacatttcattaaattggcagctcttttgatgaattcctgatttctcaaatattttgtgatagaacgtaaggacttaaccatcccttagtcaaatactacaagcaaatttaataatatctggaagctttaattctgttgtcattttcacccatttgtaaaaacagagatgtctcatctgagatagaatctcttattctaagaaaaaccagggattccttgctttctgagagctgcttttcaaaacatcttttcagtggcactctactaatttcctgcattttggtaggcatggtgattgcttatcatcaatttcttctaattcaatgaaaaaaaaacaaagaattgtggataaacctcaaggtatatttttagatgtttgtggttttaaattaatatgtgtaggccaagagcatagatgggtggtgtccttttcttcttatgagagatgtatggaagaattatctggacactgccaagaatgttccttggaatcatcactgggaatcaatgacttttaaaacatttaaaaacccagctttttttttttttggtgagaatgcatctcagaaatgatcactaaaatcagtgctggaattctcaacataatgacatatattgttcaagacatttttatataaaataacatcaagctgtaacattataattatgttcctaaattgtattctcatttataaatctctcattttgctgccatagttacttgtatgattttgtgattttgtgtttttccatttaaattttattgtttaacattaccttgatgccatttttagagcatatttaaatacatttgagcagaaaatagaaagaaaagagtcatagtagttgattttgtttatcaactggtgtaacaactggagaatgttgattgcatttgatttcatatacatagagatatgaatggttaaagtcattctggaaaaatcaaaatacataagtaacaataaaatttaatattcaagttgcaggtcgttgtgactgaaaaaaaaacattagtgacaaaaaaatttatctgtttctgagagttttgttttaaggagagcaagaactagtattaggcatggcactagagaagaaaatcaatttttaactaaaaatgtaattgggctgactgggagccagaagcaattgtatgttttacatactcaaatgagtaaatacatgcaagtaattgtcaaattttagctcaccagtctttaagcaaatcagtcaaaggatctaagtcacatttgtatttttgagccacatgctttcaagattttaatagtggctacagataatcacctataatgtaaaaattgtccattctttctttagttaacatccccaaaatgatgtttactgtaatttgagaaaatggaagtccagttttaatgttgcagtttaattatgcccataagactggacaatgcaggattaaagacactagtgttagcctcaatacaatgtgcagtatttcatgatttgatggaaaaagccattttatagtgtgactcttaagtctttattagttatatgctttataagtaatacatgttttaggcatatatatctgtatttttaagcctaggtagatatggttttctgatcaaatctgtggtcagaaaaaaacacttgttttctctgtattctgacaggaaaggaaaaattatatgcttataaaaggatactcaaaccttttgtatttataaatttgcattctagaaaaagctgtgaaagaactgagagtgggagaattttgaatatatgtatttcccttgcttcagttcttttcaaataattgactacttatgaaaagcttggccagaaaaaagtattcccaataattttccaaattagatctaaccttctttacatggtcaagaaactaaaaattatatgtgaattcttgctgcttaaaattcaggatacattttctctgaagcatttgcttagattattaagagagtcaatataaaacaatgttcttgtactagtgttgggaattaaaaatgtgtttgaactgagtaaggacttatgtgaatgttctgtgctagaatgatggggtattgtgatccatttgagtctgtgtttatccccaagagtgaataaaataaatggccaggttttatacttgatgtaattatttgtatttcagtgggtatttcccccctggaaggcaaagcaagttctgtgtgatcttggcattagtgaattttagagctaactacataaatgtgtaatgcactgttttaatctttaacgctggagttgtctttatgtcattggtttcattcaagctgtatcaaagctgggtcacgtactagaaagagggacaactaaattaagatatgcttgcccagagatgttaaaatgtaaaatgttttggggaaaacctcaacatcaaatgtagtttcttaagtatagaagttcttttctcatggtctttaagactatagagatttcacagatacaccaataccttctatatgtgctcagttaccttagagatgttaaaattggggcgcacaaagaaaagacctcagcaatcagaggctttaaagtgagacctcaaccatcagaggatttaaagctttagcttacaaaattttattttacaatcacaatcttccaatgatgtttaagctggatgagtaagatattattgctaaagttatcactcataattcagtggaaagtttgtgtcataccctattttgtgacacaattttaaagtatttatacattcaaactgacagtatgaaaaatacaagttttacctagaagatttctaacactagcaaattgacagtagtacgttatcaccaattgacctaaggttataaatgtatgtttgaagagatacatatgatgattttatttaggatttggacattttaagagatgcatgccagtgcccccagaaatctatcatagacttgttttacaagagtcacaacatacatgtaaatgtgtcttccctgttggagcctcattgaatatgtggaaggagagcttcatctcaaaaggaccattgacatgaaaactaaatggtatgacaaggtccttccagaaaacaaacccctttggatgggatcaaaagtggatccatgtcatacttgattacataccacagaagatcaagttatgctgaagcttcatgtttactttaaataacaagatgtaatcctaaagcagtccctttgtattgtatccattttatccataagtgttgatagttcctaattttcttcccattcatgttttgtcaataccggagaaggtcaaaatgataaaagaatgttaccctttaattctaccttttttcttaaattgaaatttctttgtagtgcaacagtaactacttttcttacactgtattataaacaaatgattataagtaaatgttgccaggataggagaagctatctttttgtattatatcctcctcattcgattttttttcaatctaaggaatatgcctattaaaacctcaatgctgaaagaattctgtgtttcaagttgagggaagctaaatttgttactttctgtgcattttcacaaacttaaatggctattggtgataggtgtatttttaatgccacttgttacaactaggaatttctcactgataattttagctaattgcatcatttattctgtacttgatttagtcaaatttttcttgtctttctaatgttctttaatgcctttttcattcatttagtcatttgattttttactctttcaatttttgtccaaagttagaaaatttttagagattataattttaaattatcacaaagacccctttgggttaagtggttatttttattttcccatgaaggttgtactttactaaactttatttttccattgcttaatgtctagtttttttaatatgagtctcaaaaagaacgtttattatttagcttggattagcttgttaaaaagagcacagttagtagagagaaatatgctgaatatatcaaatatttacaatgagctttacttggtacaaggcatactgatgagccagatggtatttccatgataaaccagttgaaatattttctgtgacttaccagtcaataaaataacaagccagatgagttaagcaataggattgactaatttcttttttctctgaagtagtattttttccaaccagttcaattaattgaaccagcttggcataatcaaacttgttatgtatttaagcatatttaagagtctttcccctctatgtatgtgctaatttaactaataacattaactgatgacattgataggaactgtttgctaaaaatagaaacctagagaaatagcagtttgaaggaaattgagggctaataattacatttcttggaagggaaaagacacaagtaccctaggtagacaattctggtaatagtccaggcagaataaaatattcccttggtcattacctcacacttcaggtgtatgtattttaaaatatgcttgtaaccattgactactactatttccttccctcctttttgtttggggagaagaagggtaggtactaaccaggaaaaattatctttagttctgtagatggtaaaagtaaagaagagaagtcctcaaaatagaaatagtgactccaggcgagaggaaagacaataaaaatttaagtttgattatgtttaaatgcttatgtttttagaacttgattttaagttcatttacagtgttaggatattttaaagtcagaaagctattagagcatttaaaaagcatactgaatattagtttttctctcacagtgtatctgtttcaaagaattggagaataatattctgttaagtgaatgttttctttgctacatttctattatggtgaacttttggtcagatttattgtttagcatcgtctgtatttaaaaccaagatgtcctgacagagaggaaaacagttataaacagagtcacatcacagtgactgtgtgtatgtattgttgaatctgccattcaaggatttgttgtagaggcatgaaatgcatccttagaaataaaatagttatttatttccttgggatttatggtattcatcagtacaggtgactcctatgattacctgtataatctcaggatttcccattgcctcaagttttgtttctaaaagacaggaatagttgaactggaccctattccaaaattagcatagtaaaacataatctttactgtgtaattttataatagcttacaattcttcaattaacatgtaaaacttctgacctttttaaaaatatcgtataaggtggaatattgtaaactcccaaattacattatcattccttttccctttctctctctctttctttaatttctacttcactacattagaatttaactgtcattttggtaggatgtatgatttcaagctattaaggtgagctgtataacagggaaggtcaaaaccgtgaactgagtcctaaattatgtagcctaccccagtgacttacattgtactttccattgtatttatgcttggctttttaagcgaattttgtttatctgtacaaaagtattgtcacaatacaaaatagttgtaatatgccactttttgagtgtctagcaatgcatattaaaacaatagaactgtgagtctatataaatatgctaagagagttttcatactggctaaaatggcaacatcttgtcatgtgaagatacagttcatttgtgatcattatttttgtgtttgtgattgcattaaaatttttatttttaatgtgttaattgtatacatagctaatcattaagatctgtaagataaacataaaacttgtgaattttagtttcacttcaggataatttcacaaaccactagattattttcaaatgctgtgaagcttggaattgggagtgctcttaagttaatgcatcctcatgtactgtttaattcagtatatatattatcttaactttaagaaaacaacctcctatttaatacttaaatacaggcctgaaaatgagatctatatatgcaactaaagattattttaaatgatagataaatgtgtgtgcctatgaatggtgaaatgattgtgttacataattaccatacttttgatgatgtaccataaaatggctttgagaagacagctatgcttattttgacagaaaaaatatgtctttctagcaaatactctcgtattggcctttcatactcccacttttgtaaccttttctgagcatctgtaacattttactaacctagaaatatggtttatcttttttgggagaagatctgaaatagctttctcatacatcaatcaggatgtgagtgagctaattcttttgagttactcatcattattgttcttttaaaggtgggattctgacaaagttaatttaatttaaataagtttctaactgtgagataaatcttcccattttgaaacactgcatggtatttttgctttataaatagtatttcagtgtttatgccatagattaaggtgagttgggagtgaagtggaaacctttaccatactgtttgtttttggagattgaaaggaatatccatgtactaaataacatgtttcttgatttcagccaagttcaaaaactgcagaaatagataattttaaaatgataactatgtgtcattgttgttgttgttgttgttgttgttgttgttttgtgtgttgtttgtgtgcgtatgtattttctttttcattttaaccagcctcttatacctagaagtcccacaagcagcgttgccacgccttccagcaccatcagtacacccaccaaaagagacagttctgccctccaggatctctacattccccctcctcctgcagaaccatatattcccaggtataaaactatcacgttgtcctaggcagcttctagctaaaggtaaacctaacagcatataaactgcaaagtcaattctgaaggaacaccttgaatattttctcacagttaggaattctgaacacattctgcaaaatcattcccattatagagcatgcatgtttattaataataataataactaatttgtatataaatacttgctgtgcattaaataatttatactatctcataataggaaagaagaagaaagtaatattaaataataattaggattattttaataagtaaacaataagtgaggctgtttggctaaaaagccccagaaaatttcaggttactttgaagcatttcatacattttttttttaaaaaaagagaaagctatagataacttttatgctttcttaaatgtaagtaatgaggaagattttatttggtaatgatgatgagggagaatgtctttttcccctaataatcctgtgtctgaaatttttatttcattaattcattaatgtttctttcaggaagtagagtttacaagggaatgaattacccttaaagtctattttctagatttcttgaggctgtatctctatttcatttatcgattcttatttgaaaatccttgcagatgtggaagaatacagctttatgtcataatgcattcttcctaaaagcattctgatatccagccttgtgaaatacaaaaattatggaaaaggactagcactaaatggggatcattaataccaatcacaaaaaaacttgattcagtttttaaattagttctgcattcaaaaacaataatttaaggtctcttgttttcaagccataaatagtattaaatttctttcatatataaaagaactaaattccttgtgtttaatttccattattctttagtacacttagtgtttcagaaatctgtattctattagatatgatggtttactgacattatgtgatctaaatgctgcatggcaatatggtttatctgcaaatactgtgttgtcatctagtaatataactatagttagttttatatatattttagttctttgagaattaaatatagccattggaacataacttataagatatagtttactaagctggcatttcataaatctaatatataatttacagtcttgtgttcaatttacaagcaaatatacaaatccatccaatatcctactaaaatgctagttgcattttaattctgttaagacagtgtcagattttccacatatgcttgcatgaggaacaatgaaagtatgtgtgttccaaacaggaagtgactttttatgatttgtttacattttatttggaaagatttttatttcagagcaaataattatttaaaaggccttattcttcagagggctacatacacagataaacattaaaagattatttttatcaaatctctgtagttttaaaatgttctttcctcttgggtagtgaggaacttgttacaaagaaagtgtctcctctacagaaaatatttaaaatacacttaagaggacaaaagagtaaaatgatccagttttgtcttctgagtgtggtggacatattataaaggctatatattgaagccaataaaaagcttgaagatgctatttaaaaatattagagaatgtgaaattgaaatatcaacatagtgacccttgttttgtcagtattgcttgaaaactccatacttttctgtaaaattcatagtgtttactatatcactgcaactgattcttagttggtcagtgtataatttaacagaatattctaaatacattttgagtcaaattattacttacccagtcataaagtctttcgatattggagtcaggacaatccatgcatcaaagcccctttgaaccacagccttatataaatgtctgcattttctggcttgattttaagttgacagtcaaaactttttgcagtcgtgattatttttacagatacagccttggcacttttttcctattttcttattttgaagatgaatgtgatggacttagtttaattcctctgaacatttttccccatattaaaaaactttgtttatacaggataggcattttggtggtatgtgaacatatatgtttgatttggatggcaaataataaaacctctctcatctcaaaaagaaaacagacttgaaaaatgataggactagttttcaaattaggcagaatttttttcatgtggttatgattttttgaacacatttaatccagaaaaaaagttattgcaaaagtgcctttttctctaaaagataaaacactcatgtatgtgaagtgagtgaaatttggttggcattttattatatgtcttgtgactaaacacagtttcattatcattatatatagtacatttctgtacttaaccaaatttctttttctatgataaaaatgtagaatttataggtctttgaacaactatgacatttaagtactaatttctcctattaactctactgtgtgccattaaatataaagttagttcagtaaagcaatgctcttttaatgcttccttaaatcctttctagagcaaaggcacagatttattacttacgtgcattaacttacaatattaagaaaggtgtaaaaactctttacatcagaatgaattaacacactgagttctccagggactcatgacgtgaatatatacattaacacacacacacacatacacatacacacatttacatacacaatacatgtatctactcattctactgaaaagtttggttttgcttggtacttttcttaattcaacagtattttactgcattctatatagatttgttttaaaaatctaccctgttgatataaggtccctccttcatattattataggaaataccatccctttcaatttcctgccacaagatgtttccatataaatatagtatgtgtattaatagggctgaatcaccctctgatttcagctgcattaacattcatgtcacaagcctcatagcttgaggtctggtacattgacagatacgcataaccttactccagtgccacaaattcgttaaggctgcttccaagctagttgcagtctcaatttctttttgatagtggactaaccaggcaatttgttcaggaaaagttttcagcaagctgaaagaaaattctgcctggattttatatttatttccttcatgttgcctaagaactatctatatagttctattgtggtaataagcaatacttttattttagaaaataaaagagtaaattgtaatgtaaatggcaacaacaccttgtgatgggttaaacagataagaaaactcactgattgtcagtctggagaatgttgtttactactttctacatatttcaaatactgggaatatagttttctacatttggacaaacctaaacatttacacacagaagcagaaatacaggcttttgccagactggggctcatattttagaattcacattacttttataagctcatcaccattttataaggtataataggaattaattaaaaatttgttctttttatctgtcttgttataatttagtttattctatgaatttaagattttagtctcatcacttaacataaaattaaattgtttttctggtttgacagcatttattcatggcactgtttagggtaaccagaaacaattaagaacaaggaagaaatttaactaatggtccacaaggggggaaacattgcatttacattcatagtcatgttctagaagacaagcttttctgacaaaaagttcataggtaagcagtgaaacatgtcataaaataaacaagattcaatttaacaaatcacaaatggactatttctatcaaaatgggcttaatctgggcttaattacctattgcagtgtgtgagtaataggttttagggagcccataaattattagagatgtttttctctagaatcctatagaagaaaaaaatcaacttgccatcaccctaaatgccattcttaaactctatattttatcagattaccttctctcctcaagaaacattgatgtataatgaaattttgatatatccatttagaatgagttctaggaatatgtctttttactcttaaatgagatacgtagagtttgaatactgagaataattcttttaaggtttattttaaattaataacatgttgtttgaatttcttataatacaagtttatatcatgctaatttgattcctaaggctgcagtgctccttatggtagttcttaaatatatttctatttttaagcagtgcagatttttaccaagaatcaatcaggtaaactggcagaagaaaacattatacttaagttaacattactaccattatacctactgtcttgaacactaaaaacaatttatgtgctaaggtaaactggcagaagaaagcattatacttaagttaacattattaccattatacctactgtcttaaacactaaaagcaatttatgtgcaaaggtaaactggcagaagaaagctatatacttaagttaacattactaacattatacctactctcttgaacactaaaagcaatttatgtatgacatggtacagtgaaaaatggacttgggcaacagttaaaagtttcatggcctatttcaaattctgtcagttattagctgtgtaacattgaggcaagttgtttagcctttctgagactcaccattttgttttcagcaaaataagaataattacaaattgccctgtaaatctcaaagaaagtttgaaaaggtcaggagatatattgtatgggagtaaattattagtattttagaccctcggccatttactaccctaacatgtttctacatcttctcctttactctaacctttctttagggatgaaaaaggaaaccttccttgtgaagacctcagaggacatatggtgggcaagccagtgcataagggatctgaatcaccaaattcatttctggatcaggaatatcgaaagagatttaatattgtcgaagaagatactgtcttatattgctatgaatatgaaaaaggaagatcaagtagtcaaggaagacgagaaagcaccccaacttatggtaagagttcttcttttatgtttatataagactatatttctggcataggaatctcaatttcctttaataagtttttgggttgtgagagttacttaggcgcttttgaatctttataattgatctgtctctctcatgtgcttctaagtggaatttctacaatatgagacattatattaaaaattattctagattttcaaaagataagaaagaacagtaggtaacattgtagctcataatgatttataaaaatctttttagcatcacatgtatttcttgtgtgttagatgttgccagtttggaaaaattcaagtgtttttttattcttttttgtttttttaaatgaatacttactgttaacatgacttatttaaaataaaattatctccatattcctcagggattttaagaaatataattttctcgagaaattctcacctcagtttttgtattttttaaagaagctgtgaaatttatttgacattagagtggaagtggattttaaatagaatggattgaacatactgtatttaaggcaaaaatgggcttagagttatgatgggcacaggattgttttaatctttgattcatgaccgaaaaagtaacccagtcacaaatacttaaaattgttatagtatatctgaaagatttgcagataaagttgcttaaagtagtcaagcttgtggttcttctgcaagaataaatggatttaattgaaagtctctgctcctccctttccacttttcaaattaataatttttagcgaggagcttatactttgaggaaggacagcatccctgctaattagttcaaacttgatcaatgggagctgagcagaagcaaagttgtttttagctcctccattctattcctacacctcacttgtctgtcatggccatatgcctccctcctttggtctcaaaagagcagtcatcacatatcttcatatacatgtcttatttcctttcagctctttggtaataagtatgaaagaaaaattttccccaaaatgatgctaaagaataggaaccatacttatcttaccttgtgttattctctgtacatgtgctttttaatcataagaataaataatatattttaacataaactcctcaactacactactctagtggcaattaaactgttaagtattgaagatatttgaacctttacttttctcctctactatattgtaaacctacaatatagagtatagaggcctgtaatctttgctatccctacccttgccccatgaaataatatgaaattttttttcttattcattcattccacaagtactaattgactgcctattaccaaataggcagtaatgtatgtcaactcttctttctttgtgtcccagtattatctggctattttctacttgtgttgaagtagataattaatgtttaatttaagagaaattatagtcaccaaatgaaagtgattgattactgatgactttattttaaaaaatgtttactaagttcttactcgaatggctataaattggtagtcccttcggactacattttaaagcccctaatgccatcatgtgccacaaatctcccccgactagaatagaatactttttaaatattagaaaatttagatagcctataaatacttgacatctttttgtaaccaacttaggagaaaagaaatatgtacatacttaaaagagagaagtaagcagagttatttgtttcattcagtatggcttttaactttctaaaattgacacataataattgtacatatttatgggatacagagtgatattttgatacatatatagaatgggtaatgatcaaatcagggtaattagcatattcttcaccttaaacatttatcacttctttgttctgggaacattcgaaatcttctcttccagctgttagaaattatataataaattattgttacctatagccatcctatagcaccgtagaataccagaacttaacttctctcatgtagctgtaatttatatccattaaccaatctcttcaaaatccctctcccactcacccctcccattctcagcctccagtaaccacagttctactctctatgagctcaaagtttttagttcccactcgtgaatgcaaacatgcagtatttatctttctgggcctgatgtattttacttaacataatgtcttccaggttcattcatgttgcagcaaatgataagatttcattcttttttagagctgagtaatattctgatatatatatatatcacattttctttatccattaatctgttgataaacacataggttaattttaatatcttagctattgtgaataatgctgcaatacacatgggagtacagatatctctttgacatactgatttcctttcctttggacctatacccagtaatgtgaatgctgaatcgtatggtagtcctgtttttagttttttaaagactctccatactaattactataatgacggtaccaatttacattctcatcaatattgtataagagctcccttttctctgaatcattgccagcatttcttattttttgtctttttgttaataaccattctaattggggtgagatgatatctctttgtggttttaatttgcatttccctaatgataaacgacgttaagcatttttatatagcagttggtcatttgtgtgtctgctttcacgcaatgtctattcagatcatttgcccatttttaaataaaaatatttcttttattgctgttgagttgtttgagttccttgcatattctggatattagttccctgtcagatgaattgtttcctttgctctacataagacttttagtttgatataatcccgtttgtctgttttttttcttttgttgcatgtaaaccttagccataaaaatatttgcctagaccaatgtcctgaagtatttcccctgtgtattcttctagtagttttataatttggggtcttatatttaagcgtttaatccattttgagttgattgtgtacatggtgagagatagggttctagtttcatttttctgaatatggatatccagttttcccagccctatttattgaagaggctatcctttgcccaatgtatgttcttgttgcctttgtcaaaaatcacccggctgtaaatacggacttatttctgaatactccattctgtttgattgggctgtgtgtctgtttttataccagtgcaatgctgatttggttattacagctttgtagtgtaatttgaagtcagtcagtgtgatgccttcagctttgttctttttgttcacaaatgctttggctatttggggtattttatggttccatacaaattttggattttttttctatttctgtaaagcatgtcattggtattttgacagggattccattgaatctgtagattgctttgggtagtatagtcattttgacaatgttaattcttctaatccatgaaaatgtgatgtctttccattttttgtgttctcttcagtttctttcatcagtgttttgtagttttcattgtagagatctttcacttccttggttaactttatttctaagtattttttgtagctattataaaggggattgcattcttgattttttttcagatagtttgttattggcatatagaaacactactgatttttgtatgttgattttgtatactgcaactttattgaagttcttaatcagttctaagagttttattgtggagtctttaggtttttctatatataagaacatattgtctgcaaacaggaacaatttgactttctcttttccaatttgaatgccctttatttctttatcttatctaatttctctggttagcatttccagtactatgttaaataggagttgtgaaagtgctcatccttgtcttgttccagtttttagagaaaaagctttccacttttctccattcaatataatgttagctgtgggattgtcatatctggcctttattgtgttgaggtgcattgctttctaatttgttgagagtttttatcatgaagggatgttgaatgttattaagtggcttttttgtgtatctattgaaatgtttatatggtttttgtcctttattctgttgaggtatcacatttattgatttgcatatgttgaaccatccttgcatctctgggttaaatctcatttgataatggtatacaatcttttttatgtattgttagattttattttctagtgttttgttgaggatttttgcatccatattcatgagggatattggtctgtagttttcttttttagttttcttcttgttggattttagtagtaggctactgctggcctcatagaatgagtttggaagaatttcctcctctactattttttcggatagtttgagaatacttggtataagttattctttaaaagtttggtagaattcagcaatgaagccagcaatgaagtcatctggtcctgggcttttctgtgttgggatcatttttattactgattcaatctcattactagatagtgatctgttcagtttttttatttctccttgattcaatcttgatacattatatgagtccaggaatttatcattttctctaggttttctaatttgttggcttgtagttgttcagaatagtctcttatattcctttgtattattgtggtatcagtggcaaagtttcctttttatgtctgactttatttgggtaatctctgttcttagtctggctaataatttattttgtttacccttcaaaaaatcaacttttcgttttgttggtcttctgtaggttttttttttttttgtctctttcatttagttctgctctgatctttattatttcttttcttccactaattttgagtttgatttatttttgcttttctgatttctttttttcctaattttttgaagtgcaatgttggagtgtttatttgaaatctttctgcttttttgatgtaggcatttcttgctataaacttctttcttagtattgcttttgctgtatcccataggtttttgtatattgtatttctgttttaatttgcttaaattttttaatttcctttttaatttcttcattgacccattcgttgttcagaagcatattgtttaacttccatataatcgtacagtttttaaagtttctcttactattgatttctagttttatttcattatgatctgaaaagatacttgatagaatttcaatttttaaaatttgttgaaacttgtggcctaacgtatggtctatcctggagaatgttatttgtactgatgagaagaatgtatactctgcagctgttgaatgaaatgttctgtaaatgtctgttaggtccatttagtctatagtgcagtttaagtctgacatttctgtgttgattatctctctagatgacctatctaatgctgagagttgggtgttaagtccatagctattattatataggggtctatctctccctttagctctagtaaggtttgctttatatttctgggtgctcctgtgttgggtacatatatatttacaactattatattcatttgctgaattgattcctttgtcattatataatgaccttctttttacagtttttgacttaaagtttattttatctaagtatacctactgatgcttgatttggtttttgtttgcatgaaatatctttttctgtctttttactgtcagtcggtatgtgtctacaggtgaagtgagcttcttgtatgcagtatagagttgggtcttgttttttttttttttttctttaatccactcagccagtctatatcttttgattggggaatttaaaccatttacattcagggttgttactgataggtgaggaattactccttcatttaggcaattgttttgcttattctttgttgctttcttctctttttgttttatctttgcagtttggtggttttctgtagtgataaggtttgattcatttatctttgtcatttgtgtttctactctaccagtgacttttattcttttgtgtgcttccatgatggaaattactgtctttttgcttatagatgtaggattcccttaagtatttcttttaggcctggtctagtggtaatgaattccctcagtcttttcttgtctgggaaagactttatttctccttcattgctgaatcatggctttgctcgttgtagtagtattagccaacaatttttttctttcagcactttgagtatatcatcccattctttcttggtctgtaaagtttctgctgagaaatccactgttattctgatggaggttctttttatgtgatctgacacttttttcttactgtttttaaatttttttctgtgtctttgacttttgacaatttgaatataatgtgatttggagaagacttttttgggtttgaatctgtttgcggttctttgagcttcctgtatgtttgtatggtatatcgcttgcaaaacttgggaagtttttagctcttattttgttaaatagtgtattagtcagggttctccagagggacagaactaataggatatatgtatatatgaaagggagtttatgaagcagaattgactcacacgatcaccaggtgaactcccacaataggctgtctgcaagctgaggagtaaggaagccagtagtggctcagtccaggtcccaaagcctcaaaagtggagaagccaacagtgcggacttcagtatgtggccgaaggcctgagagccactggcaaaccgctgataaaagttcaagaatccaaaggctgaagaacctggagtctgattcaagggcaggaaccatctagcatgggagaaagatgaaagccgaaagactcagcaagccagcttattccacctccttctgcctgctgtttctagccatgctgacagccagttggatggtgccacccacattgagggtgggtcttcttctcccagttcactgactcaaatattaatctcctttggcaacatcctaacagacataccttgaaacaacactttgaatccttcaatccaatcaaattgacacttaatattaactattacaaataggttttctatgcctttgcccatttaatttacttctggaacacttaaattcaaatgtttggtcactttatggtgtcccatttgtcatgtagagtttctttattcttttttattcttttttctttcttttatctctgactggattatttcaaaagacctgtctttatattcagaaattccttcttaagcttgatctagtctattgttgaagttctcagttgtatgtttttatttcattcattgaattcttcagttttaagatttttgtttggttcttttatatgatatctatttttgttgaatttctcattcagatcatgaattgtgttccttattttgttgaattgtctgtattttcttatatctctctgagtttccttaagatcattattttgaattgcttttcaggcatttcatacagtttttttttcctttggtgtatattgctagagttgtgttcctttggaagtgtcatatttccttactttttcatgtttctcatgaccttacattgatatctgtgcatctggtgaagcagtcacttctttgaattttgtgggtttgctttcacagggaaagacatttttctgcatttgcattctatagtgtcaattgggtagggtgctttgtttgggttgtgtgtgtgtgcacagtagtgtaatctccatatgatatctttgtctatagtcactcttgtattctccaaagttttttttttaacttttgaaactgaaacaaatataaccttaatgtagatacttgtagatacttcactggagattcctcagtacaagaactgaagattgtttcaagtaaataacagtttaatgtatttacctttttaaaattaaatgttaaataataaaacctatatgtcaggcacaggactgtgtggccctaattttcccaacaatttatttgttaagtcattcaactaatacttgtatacataaagtcagccagccactgggacacaaaaatgaataaaaccataaatcctaattacccaaagggaagaaacaaataaatagatgcatcacagtcacttcaggtaagttggaaggtgtgcaccaagtgctgtagtagcctaggaaataaagtctcatagtttgccttggaagtcaaatgagtacacatgacatttatgctgggttttaaatgatgaatagcgatttcatccagggtttttaaatgctagtcatcccaccaaatacctggtaccttctcaagcctatgtctgagatctgaagatttgtctaaatatctcagcccagaccctaacgaccccaacagaaataacttcaaaccttcataagcaataatcaatgacaacttttttatttaacctataaaatagtcccattacctggactcccaagtgcgacaatattatcttgtatttgaaaataatgataacgaaagtatgtaatcctgcttaaatatattgtttaaaaaaaaactaaagtacaaaaaactacatacttgacattttctggaaataatggtaatttaatctcttagcacttgtgtgataccttaaaatgcactatgtaagtcttttatccttagagtgttcaatttctgttcttggtcacaaaaacccttaccttgaagtatgtgaatttagctaccacttctttcctattaacttcccagatcatctgtttactcaaagagactttagagttaagattataagaatatgggtaggattttgagaagcaaaagcgatatgacacagttcttcatatgtgctttcagttgaatgtgtatgtagttgctatattttccttgtacattcatattctaaatttagacatctaatagaaaaatagggacactctgttattaaacacagtgacaaagaaacacagatgtaaagaaaaatatttgaaaatatctggttgttttttttttttgagatggagtcttgctctgttgcccaggctggagtgcagtggcacgatctcggctcactgcaacctccacttcccgggttcaagcgattctcctgcctcagccttccaagtaggtgggactacagatgcacgccaccacgcccagctaatttttgtatttttagtagagacgtggtttcaccgtgttggccaggatggtctcgatctcttgacctcgtgatctgcccacctcagcctcccaaggtgctgggattacaggcatgagccaccacgcccggcctgaaaatatcttaatagtagcttttaaagtatgttatttaacgaagattcttatgttataccatggaccctctagttgttaagaatgagttaaaagaagtacaggtatttaccctaagcaattaaacaaatacagtatggactgacagtagatggcatttctagaaaataagtaaatacaataagccctcatttaacatcatctacaggttcttggaaactgggactttaagcaaaatgatgcacagctgatcccaatgccatttccttcaatatcattttgttataacaatgaggaagaagatggttttgtaatctgtggtttcactttaagtcccagtttccaagaacctagagacaacattaagtgaggacttactgtaatacctgttgagcgttcaggtatgccaaacacagttctaagcatttaaaagcattaatctatttaatcctcacaacaactctatgaggtatgtactaataaaatatttgttttacagatgagaaatctaaaaaacagaaaggttaaataacttacccaactagtaagtgatagagctaggattaagtactcatggatatttttttgacccttaccagtggtaatgctagctaaatgtgatgaaaataattttttaattgtaggtaaataatttccaaaaattacattcctcgttctaaattcaagaatttgattccagcaagcagaaccaagtctgattttatatgttcttgtgtatgttgttttggatttactaacactataacgagcatgcatttacatagatatgaacctgacaggccttaggaaaagactgctaaatttagatgtaaaatgagcaacaatgtgttatgtcctttttaaatcagagagtataaaataggtttactttcctaaaaagatagacaggaataacttatggaaacatggataccagtagcagaagcaatctagattagtagttactagcattggctgtagcatcagccatagttggtaattttgtctgccatctaattattccagtgtgaccttggggatgttactctgggcctcagttttcttattaaatgaatatgataatatctgccttgtagagttttgtgagatttaatggtaagacattgtaaattgcctcagtgcccagtatgttgggtctttgttttcattattatcattattacatagaagctttaacatggaaatagaaacagggaaaaggtggcattaaatcattttaactatatagggtctcattgctcaggcttcaaaggcaaaggcttaaatttgatgagatcagttgcttggcaacttttcaaaatggtaatatttcccatcagcttttccatcttgctgtacatggactccttgcccttgctatttcatcataacacatttctatgcatagaaacatgctaaaaggtagacacagttggctgagtccctttgtggccatgaatggtcatattttataagaataggaggaaaacatatcttttaacaataatatcaccaaatagtattggtttgaaggtaggaatccagaccttttctgatttattgaaaatccaggacctcacaaaaagcacaggaatgaatgtaaagctgatattttagaaattatcctcataaatgttacttgtacacattgtgcattgaggaaaattaatctctgtaacattatacctgaacattttctacctgagtagttgggacaagagaaaatcaaatactatgtcctttttatccacataaatagcaaacggcttgagtgacatatagcagtatgatgaagggcctatgggcaatgacatcataaactgagttttatcaatgtgaagttaggatagcgtctgtaggttccagggtctctctgtcctgtgattttaaaatgtaaataatcttccttatcaggtaaaagttcagctgtcattaatcagctattctggagacaaaagaaaataggattctacccatgggaaatttttgtgttcaagtaaaatgtacgatttccaaagaagaactaaccacagaaatagaaattagtgattcaaagatgaagaaatgtgggatgtgcactatattcatgggaattcttattcctttagacttatttaataaagttcataaagactacatgttggttagcctcacaaaataatttttagcatcaagctgatggtggtaaggaaccatgtaattgatggaaaagcagttcaacaatattttgacatagaaagtagtctgtttctattgtaaaacttggagaaatcgtctaaggaaggcattcttcctgaatttgtgcaattttactgatggaaatggaagagcatgaattatgaggtcaaatagacttgaatttgctatcacagcttggcttttaatagctaattgaccttgagcttcagacttaacctccctgtatttttgtttccctgtctgtaaaatggaatagtaatattactcatggtgtttttttatgaggattaaattagataacatacgtcaaatacttagaagagttcttttttttcttttcttttctttttttcttttttttgagacagggtcttgccctgttacccagtctgtagtgcaatggcatgatctcggctcactgcaacctccacctctcgggttcaagcaattctctgcctcagcctcctgagtagctgggattacaggcgtgcatcaccacgcctggctaattagcagagttcttgcctcatagaaagtactcaagaaatgatgccttagatggtataataaatgcttgctgctcataaataaaaatgtcccaaagatttttcaagtctcctgtggaaggacttagttagtaaaggacaaagtatctagaagtctttccacatgtttggtcactctaccaagccaatagctggccatttaaattatagcagttaaatatgagtagagctttttggtttcttttggtttgattttgcaaaccaaagcagaaggaagatctttcaaatagttaataacactgcaaactgccctcatccaaatcctcttaagctccagtataaaaatcatcagctcacatgctggattagaagggcccagttataatctctcagcgtcaggaatctgaaaacagttcagcccccacatctttttaaagtttttgattagttgcttaaaaaatggaagaatagtatattatataaaataaataaaatggttggagagccttaaagaaattaaacctaggaagaaaagattattctgaaagaattcaaggtactaggtaatggataaaacagtaagattaagaaaaagaactttcggtggctggcaagatggccaaataggaacagctccagtctgcagctcccagagggatcaatgcagaaggtgggtaatttctgcatttccaactgaggtacctggctcatctcactgggactggttagacagtgggtacagcccgtggagggtgagcagaagcagggtggggcgtcgcctcaccctggaagcacaaggggtcggggacctccctcccctagccaagggaagccatgagggactatgccatgaggaacggtgcattccggcccagatactacgcttttcccatggtcttcgcaacccacagactatgagattccctcaggtgcctacaccaccagggccctgggtttcaagcacaaaactgggcgactgtttgggcagacaccaagctagctgcaggagttttttcctaccccattgacacctggaatgccagcgagacagaaccattcactccctggaaagggggctgaagccagggagccaagggatctagctcagtggatcccaccccgacagagcccagcaagttaagatccactggcttgaaattctcactgccagcacggcagtctgaagtggacctgggatgctcaaccttgctgggggaaggggcgtccaccattactgaggctttagtgggcagttttcccctcacagtgtaaacaaagcctctgggaaattcgaactgggcggagcccaccacaacctcggcaaagccacggtagccagactgcctagattctcctctagattcttctagtttcttcctctagattcttcctctctgggcagggcatctctgaaagaaaggcagcagccccagtcaggggctcatagatagaactcccatctccctgggacagagcacgtgggggaaggggtggctgtgggtgcagcttcggcagacttaaacattcctgtctgccagctctgaagagagcagcagatctcccagcacagcgctcgagctcagctaagggacagactgcctccttaagtgggtccctgacccccatgcctccttattgggagacacctcccagcaggggttgacagacacctcatacaggagagctccagctggcatctggcaggtgcccctctgggatgaagcttccagaggaaggaacaggcagcaatctttgctgttctgcagcctctgctggtgatgatacccaggcaaacagggtctggagtggacctccagcaaactccagcagacctgcaccagagggacctgactgttagaaggaaaactaacaaacagaaaggaatagcatcaacatcaacaaaaaggacatccacacaaaaacctcatccaaaggtcaccaacatcaaagatcaaaatagataaatccacgaagatgaagaaaaaccagcacaaaaggctgaaaattccaaaaaccagaatgcctcttttcttccagaggatcacaactcctcaccagcaagggaacaaaactggacggaaaatgagtttgacaagttgacagaagtaagcttcagaagatgggtaataacaaactcctgagctaaaagagcatgttctaacccaatgcaaggaagctgagaaccttgaaaaaaggttagaggaattgctaactagaataaccaatttagaaaagaacataaatgacctgatggagctgaaaaacacaacatgagaacttcgtgaagcatacacaagtatcagtagcagaatctatcaagcagaagaaaggatatcagagattgaagatcaacttaatgaaataaagcgtgaagacaagattagagacaaaagaatgaaaaagaatgaacaaaggctccaagaaatatgagactatgtgaaaagaccaaacccacatttggtcttgtttggtgtacctgaaagtgactgggagaatggaaccaagttggaaaacactcttcaggatattatccaggagaacttacccaacctagcaagacaggccaaattcaaattcaggaaatacggagaaaaccacaaagatactcctcaagaaaagcaacgccaggacacataatcatcagatttaccaagtttgaaatgaaggaaaaaaaggttaagggcagccagagagaaaggtcgggttacccacaaaggaaagccaatcagactaacagcagatctatctgcagaaaccctacaagccagaagagagtggggggcaacattcaacattcttaaagaaaagaattttcaacccagaatttcatattcagccaaactaagattcataagctaaggagaaataaaatcctttacagacaagtaaatgctgagagattttgtcactaccaggcctgccttacaagagctcctgaaggaaacactaaatatggaaaagaaaaactggcaccagccactgcaataatatacaaattgtaaagaccatcaacactatgaagaaactgcatcaactaatgggcaaaataaccagctagcatcataatgacagaatcaaattctcacataacaatattaaccttaaatgtaaacagactaaatgccccaattaaaagacacagactggcaaattggataaagagtcaagacccgtcagtgtagtatactcaggagacccatctgacatgcaaagacacacatgggttcaaaataaagggatggaggaatatttaccaagcaaatggaaagcaagaaaaaaaaagcaggagttgcaatcctagtctctgataaaacagactttaaagcaacaaagatcaaaaaagacaagggcattgcacaatggtaaagggatcaatgcaacaagaagagctaactatcctaaatatatatgcacccaatacaggagcacccagattcataaagcaagtcctgagtgacctacaaagagacttagactcccacacaataataatgggagactttaacaccccactgtcaatattagacagatcaatgagacagaaaattaacaaggatatttaggacttgaactcagctctggaccaagcagacctaatagacatctacagaactctccaccccaaatcaacagaatatactttcttctcagcaccacatcacacttattctaaaactgaccacataattggaagtaaaacactcctcagcaaatgcaagagaacagaaattataacaaacagtctctcagaccacagtgcgatcaaattagaactcaggattaagaaactcactaaaactgcacaacaacatggaaactgaacaacctgctcctgaatgactactgggtaaataatgaaattaaggcagaaataaataagttctttgaaaccaatgagaacaaacacacaacgtaccagaatctctgggacacatttaaagcagtgtgtagagggaaatttatagcactaaatgcccacaggagaaaatgggaaagatctaaaatcgacaccctaacatgacaattaaaagaactagtgaagcaagagcaaacacattcaaaagctagcagaagtcaagaaataactaagatcagagcagaactgaaggagagacatgaaaaacccttcaaagaatcagtgaatccaagaggtggttttttgaaaagattaacaaaataaaccactagccagactaataaggaaaaaataaagaagaatcaaatagacacaataaaaaatgatgaaggagagatcaccactgatcccacagaaatacacactaccatcagagaatactatcaacacatttacacaattaaactagaaaatctagaagaaatgggtaaattcctggagacatgacaccctcccaagactaaacaaggaagaagctgactccctaaatagaccaataacaagttctgaaattgaggcagtaattaatagcctatcaaccaaaaaaagcccaggaccagatggattcatagccgaattctacctgaggtacaaagaggagctggtaccattccttctgaaagtatcccatacaatagaaaaagagggactcctccctaactcatttcatgaggccagcatcatcctgataccaaaacctggcagagacacaacaaaaaaagaaaatttcaggccagtatccctggtgaacatctatgtgaaaatcctcaataaaatactggcaaaccaaatccagcagcacatctaaaagcttatccaccacgatcaagtcggcttcatccctgggatgcaaggcttgttcaacatacccaaatcaataaacgtaatccatcacagaaacagaaccaatgacaaaaacctcatgattttctcaatagatgcagaaaaggcctccagtaaaattcagcaccccttcatgctaaaaactctgaataaaataggtattgatggaacgtatctcaaaataataagagctatttatgacaaacccacagccaatatcatactgaatgggcaaaagctggaagcattccctttgaaaactgacataagacaaggatgccctctctcaccactcctattcagcatagtattggaagttctggccagggccatcaggcaagagaaagaaataatgggtattcaaataggaagagaagaagtcaatttgtccctgtttgcagatgacatgattgtatatttagaaaaccccatcgtctcagtccaaaattgccttaagctgagaagcaacttcagcaaagtctcaggatacaaaatcaatgtgcaaaaatcgcaagcgttcctatacacccataatagagagccaaaccatgagtgggctcccgttcacaattgctactaagagaataaaatacctaggaatacaacttacaagggatgtgaaggacctcttcaaggagaactacaaaccactgctcaaggaaatcaaagaggacacaaacaaatggaaagacattccatgctcatggataagaagaatcaatatcatgaaaatggccatactgcccaaagtaatttatagattaaatgctatccccatcaagctaccattgactttcttcacagaattagaaaaaaactactttagatgtcatacggaaccaaaaaagagcccatatacccaggacaatcctaagcaaaaagaacaaagctggaggcatcacactacctgacttcaaactatactacaaggttacagtaaccaaaacagcatttactggtatcaaaacagatatatagaccagtggaacagaatagagggaggcctcagaaataaggccacacatctacaaccatgtgatctttgacaagcctgacaaaaacaagcaatggggaaaggatttcctatttaataaatggtgctgtgaaaactggctagccatatgcagaaaactgaaactggaccccttccttacaccttatagaaaaattaactcaagatggattaaacacttaaacgtaagacctaaaaccataaaaaccctagaagaaaacctaggcagtaccattcaggacataggcatgggtaaaggcttcatgactaaaacaccaaaagcaatggcaacaaaagccaaaatagacaaatgggatctaattgaactaaagagcttctgacaggaaaagaaactatcatcagagtgaacagtcaacctacagaatgggagaaaatttttgcaatctatccatctgacaaagggctaatatccagaatctacaagaaacttaattaaacaaatgtacaagaaaacagccccatcaaaaagtgggcaaaggatatgaacagacacttctcaaaagaagacatttatgtggccgacaaacatatgaaaaaaaagctcatcatcactggtcattagagaaatacaaatcaaaaccacagtgagataccatctcatgccagttagaatggcgatcattaaaaagtcaggaaacaacagatgctggagaggatgtggagaaataggaacactttgacactgttggtgggcctgtaaattagttcaaccattgtggaagacagtgtggcaattcctcaaggatctagaaccagaaatagcatttgacccagcaatcccattactgggtatatacccaaaggataataaatcattcttttataaagacacatgcacacgtatgtttattgcagcactatgcccaatagcaaagacttggaaccaacccaaatgcccatcaatgatagactggataaagaaaatgtggcacatacacatcatggaatactatgcaaccataaaaaaggatgagtttgccgggcacaggggctcacgcctgtaatcacagtactttgggaggcagaggcgggtggattgcttgagctcaggagttggagaccagcctgggcaacatggtgaaccctgtctctactaaaaatacagaaaattagccaggtgtggcaggatgtgcctgtaatcccagttgcttgggagactgagacgggagaatcacttcaacctgggaagcggagattgcagtgagccgagaccgttgcactccagcctgggcaacagagcaagactccatctcaaaaaaaaaaaaaaatgagtttatgtcctttgcagggacatggataaagctggaaaccatcattctcagcaaactaacacaggaacagaaaaccaaacaccgcaggttctcattcataagtgggagttgaacaatgaaaacacatggacacagggaggggaacatcacacaccggggcctttcgggggttgggggactaggggaaggatagcattaggagaaatacctaatgtagatgatgggttgatgggtgcagcaaaccaccatggcacgtgcatacctatgtaacaaacctgtgcattctgcacatgtatcccaaaacttaaagtataatttaagagaaagaaagaaaaatcacttttaataaagttcggtggtattcatatgtagataaaatagaagtattagcaaaccaaatcaacatagctgatgcaactatgaggggggaaaaaaacctcttcagatgaattaatcgaaaagatatgaactagatgaaatagtgttcccttataaacagaatgggaaagccaagaagagaaacagtctcactcagtgattctctgggttcagtattgtcccccaggggacatttggtaatttccggggacaattttgttgtcacatttgtggtggaaagttgctactggcatctaatgggtagagaccaaagatgctactaaacatcctgcagtgctcaggacagcacccaacaagaatgatctggcctgaaatgtctgagaaaccctggctaacttaagaatcaatttacaaataaattgaatacagaagcagatactagaaaatcaaagtcagagaccttgtatggcacagaggtgattgccttatatttttttaattgaaagaacctgggaagttactgccctggaaagatataccaacatttattcacagttagtatattctctggacagaagtattcatttaaggttgttagcgtcagggattacctagcctgttctacaatagataatctaatcatgacatcccctggagcaggagacaatacgtttatccctagtcgaaatccgaatacattttcccccatgagaaaaaaaaaaaaaactataataaatggtagctaggtaaagtttaaatagggctattcatgttagctttcagatcacaatatgacttaagtaatccagcgatttcctaagtacgttcttcagatcactagttctgaaagatagcctatggaagaaagaggttatatggttaaataagattgggaagttttacatattttaggcccctcttggagattaataaattcacattcacatactacatctttgaaagttttgttgaatttgggttaatttactgtttcccaaatgtgtttgtatattaaatcccttttttggtcacataatacttaccagcttcccaatggaactaatgttttatggaatgtattttggaaaatattgtaaaagacttttgcagctcttcttaaagacccaactaccaatgatacgatttctttgtgtcttaagttccaaacagctgacttacagataagcatatagaacaacctctgttctcaatatttaagcctgcccagcggttggattattgaatgtcatcttcattcttcattcttatcttgtagaaaagccatatgtaaactactttctagagtaaatcttatttatgatgaaagttcaaactaaagtaagaaaaactatctagaaagatcattacatggtgttctatacttcaagccacttgtggaattactactatcactgcaaaacaatttgccagaagtcatggaagaaatagatccttggggatagaaaatgtcaggtgtaatattcagtgttcaaaaagagataagtaaaaattacacactgaataatgactggagacattagagcaaataattaaaacagtatacagccatttaaaaatgtacatatgacaacttagcattgttttataagcaacacatcatgtcataccaatttatttgccatcattgttaaggtattggaccacaaacaaaaagttgcatccacagtttatgctgtaatcctccactagttcttcacatagccttagtattttgcaagagttgcaaactggctgtgaggacacttaaacaaacaaaaaaaaactaatcatacatgccattaaatttttgaagaaaaattaattggatttttgtctaatgtaatggtcttgaatgatacatcactgaggcaatttgatgtagtgaaaagaggtctgggataggaacttgaaagtctgtattcatggactgactctaagtgtttattaccctgaaacttctttagttttttttcactgaatatctgtgaaatcagattatctgtgaaatcagggagaggatgagggtgaagagtattaacctgtgtgctgtacttttacactccattgtcttctaattgtcttatttttgttctgtgaatgtgtccattagggtcctacattgtcaataaaagtgatgtttccattacaaaaaaaaaaaaactttggtctgtctgaagtttttcatctctacctttcttgctggcttcactaacaagtaatggtctcagaaaaataggtgaaaggaattgtaaagttattacaagatgtcatttattttcaaataagaatgttcaactagttaccttattatctttttttacttttcatgagagtgactgtcttccatatgctgataggatttgcaagacacactgctttactaaaatttttaaaactagactgctttaatttgcagttctttaacttgagaactgcatgcttttaaccaataatatttacatgcctgtgtcatctttcttgttcacatttatatcaatgctgagcacagcaaagagacaagtattttagcctagctcattttataccaaccagagccttcagagtacccagaactcttttgccacttaaacagtatttaaatcatctaaatcctttctcattcctcccacacccctctaatgtagagaaattgtctctatgaacagagacaacatttcaactatttcagctatttcaacagatttccaaactccaatgtgtatgtatagcttgttccctcttgtggtggaatacttacaaaaggtaatttggttcaaaatataattagccttggaattaggtgttagaagtgccgcataattttttgacgcagttcagtattttctcctttagcaattctttcatgttattccccatttaaagtatatatcacttttagaaagcagtaggaaaatacacaaccacaatggagcttattcttggaaatgatttttttaactttaagtttaggggtacaagtgtgggattgttacataggtaaacctgtgtcatggggttagttgtacagattattttatcctcaggtgtttagactagtacccgttagttgtttttcttgatcctctccctcctcccaccttccaccctccaaaaggctccagtgtatgttgttcccctctgtgtatccatgtgttctcatcatttagctcccacttgtaagtgagaacatgcagtatttggttttctgtttctgtgttagtttgctgagcataatggcctccagctccatccaggtccctgcaaacaacatgatcttgttcttttttatgaccacatagtattccatggtttatatgtgacacattttctttatctagtctatcattgatggacatttatgttgattccatgtctttgctattgtgaatagtgctgcaatgaacatacacatgcatatgtctttataatagaatgacttctattcctgtgggtatatacccagtaataggattgctgggtcaaatagtatttctgtctttaggtctttgaggaattgccacactgtcttccacaatggctgaaccaatttatactccaccaacagtgtataagagttccttttttctttttttccacaacctcaccaacatctgtctttctttttttttttttttactttttggtaatagccattctgacaggtgtgagatgatgtctcattgtggttttgatttgcatttccctaatgattagcgatgttgagcttttttccatatgattgttggcagcatgtatgtcttcttttgaaaagtgtctgttcatgtcctttgcccactttttttatggggttattttggaaatgagattttaactggttttgttctctgtcaatgaaactgaaaagattttaaattaatcaatacaaagtttatatttgatttgtattatttataagtcattaaaggtaatccttaaataatcctcacattgaaatgtttacaaaccaatttcttcagcctcttttatccagaaatgaaatttttaaaatatgcctataaagatcagatcgttcattcttattttactggatccagatatgttaccattatcctttaaaaattactgactttccatttaattcagttttacttcctctttaaatgtgtgattctctaccttaaataaccccaggatgttttcctagaaattcagtcagccatctgaaagtaatttttctgtctggtatgtggggtttttgatgggtgtatgtggcaagcatatagcttaactatactcactatactcattttcatcaaaatattggctaaaatattcagaacagatgtatatatgtgtatactttttctgagactctagagaaagcttttttgtgaacattaaagggcatgtcagacttatggagaaatttctttgaaaatttttttaaatctttgacaactgtaagagaagattgcttctcaggtgctgtttattaccctgaaacttaatgactttagcgtgcttttagagagtttttaaaagcgatacaaatgaaaaaggcagcaattcagtggtgtttcaacagacaacatgggaatgtatgtagataagaaatcaagagacagaactagttctgacttgattggcaaacagttctgtaaagctcagtttgtcagaaaaatgaagagtattggtgagggtaacatacttgccttagaaggaaggaagagggaggaaaagaaggaaatggaaaattagaaggaaggaaagggaaagaaactacgaaaatagaaactaatgatacagcttggatcctttttggtctagtgtctgaggaaagtcccctatttactttcttaacaagcagtgagttaaatattgagcagttactgtgtttaaggtactgcgctaagtgtgggagataccacagtagacagtagaaaagtctgtcttctcccatgaagtttacagtctagaagggtgacagaattcaagtaactaaattaataaatacttacgtgactataattgtcatgctacaaagaagaactttgagaggaaatgagacaaacacagagaatcctgacctagaatgagaggccaaggattgtatccctaaggaaatgacatttttgcttagctctgaaggatgcatgtgaatttatgataagaagagaggaaaatcagaagacagagtcttagggtgccgggtaaggaaagtgtttcaaggaaggagtagtactcggtgctaatgctacagatacatcagaaaagtcaaggactctgagaattgtgtattggatttagcaacatggaggccctaaaaaccttgacaatagcagttttggtggaatagtggggacaagagcttaatcggggaagattcaagaggggaggagaagaattgggggctacaaatataaagaagctttctacaaggttttctgtaaagagaaacaaaaaataaggtggtagctgggtagaggtttgtggggtgaggagagttactttttaaaaaacgattggagaaattacagcatgtttatatgctaatgggaatgactgagtagaaagagaaaagttgatgatgcaggagaaagaagggaggattgctcaaggcatgcccttgagtaggtcggagggaataggatccaatgagcaacccagtaatttcagatctccctaatgtcacaatacagtataataagtattgtatatatgctaaaggcactaggaaaaagcttagggagcccagtagagtgagcagttaactctgccaaaggggattgtagcatttgtgatatcacctaaaatgcttatctgaggtaaaaattagtttattttcaagcaatgttgtacactagcattaaagcatagcaattttgtattaaaatacagtaattaggatatatcattatacagcacttcatcattgtctatattcttaaaattgtattttgtgttacatttgcttaattgcgctgaatatagtccataattcttaaaaacctacttgccatcaatatcataataaaattcagacaaaatccaaaaaatagttatctttttttctgtgtgcctctataaaaatatttatcttttacctttaccacatttattagaatacaggaataaatacagcacaaaatttctgcctctatggagacaccaattaaaaaactctagatgtgcaacagatattaaaagccaaataaaataatggttatactatgaggcactagcacagtggtatcacaaggcttatgatagggtgccaaatgaactctgcaattaatgcatgctttatacttaaaggaataaaaaattaagaagtggtcagcaaaaatatttaaatgggccctaatcctcgttttctagattatattctttgctgttattattcttatcatgaattagtaatcttaactttacaacttcaaaaaccaatataagtactactatgtaaagatatgtcttaaacttttccagattacttttcagagatttatgttttatttatgttcatttacacaggaatgggtcagatgtatttaattttattaaaccaatccatttgtattaaagccttaaaaagtcatatgagtataaaaatactttgcatgtattaataatagcatatatttgatttaagtctataatgcttatagtactcttgcctttggtgttttgtttcacttggttttttaccaacagcactaaaacattgaatcatagatttatctttccatttgaactttgctgtcctgtgaaattaaaatgctgctgtatacatgcagtagcaaacatattttcaagctgtaatcaatgatctgtatatttggaattagaaataatttaagccatggtctatttttcagtctgccatggactgctatttatacaagaatgttaccttatgttattggtttaactgctttattaagtcgacttcagtatttcagcacaattaaaaatcaatacttataagcaacattatttgttctacctaaatcaataatatactttattttttaaaatacttatttttatttgcattgctgaatctatggttttataactaataaaagcaaaaccttgatgttctccaaaagtaaatttcagtaaagctttttctttcggtttttttctaatttagtatattttccttcaattgtgtattagtaatatacagtataattctgttaaaaaaaaaaagtcacccccggaaaagtcagtgttaaaaatcttctgcataattgtttctatggctaattatacaaccagacatatcaagggcttaattacatgcttcaatgacttagctccattaaaatttcagagatgacgcaaaatataatgaatacaattatgtatttcatattctgtgtgtgaagtatgtttcttcttgtttttgtgcacatatgtttgtctccaaacaaccaattttcaaaaaatatctaactagctttttaatatatataacatatagagcaagtgaaacaactgcttatttattggattttcacttttcaaaagattttttgatgacatgtaaaaacagtgctagagctgttaattgcttcagtttcagtgcccatgctgaagtagagtttatttctaaaaccagatcctaaagaaataaattgtagatattttgaaaatacagccttcataacattgaaaatctggaggactgactgtgcaaagtggtgggaatagacataacaaaaggagaccttccctcaaacctttaccctactttcgatgggcagaatattgacctggatctatagatggctgttgtgagacctcggttcttcttagcttaaaagaatttaaacaagagacacacagcaaaggagatatagtatagagcaatttattgcaaaggacaaagaatattatgaaagttaggttcagaacagacagtacaccctgagagaggattcagggtgagctgctcctaaggatgagaccaccaagactggcactagggagactccctttatgagagtcttacataattattcataaaggagtgggaagaggtgttgctattaagcatattcttggttgtcctctgggtgcacatgcatagtagctgtacatacttgttcatacattgcatgtctcattagcatcttaaatctctatccaggggtgtgttgcttactgttataatgaacaaagggtcggtctgaggacaggtgtaatcaaaatgcatgtgctccctgcaggggaaattccttactgtagatagctgtgtttgaatgagctggactacagtgtgagtgctggggcttattgtgttaactgtattgtcgccatgtgaggacatgtttacttccttgactacctatcctgcctcagatcatctcactcaaattccctctgtgtaaaagagcagagatatactgttggagaatttggaatattaggtgatcatttacaaagttgtttgcataccttgaaaggaagccattaaataaatattacatttttggctcattaataattttatcatgtctagttaatcttcagattttaaaagagcttagcaaaacagactaaactgtatcagtgttcacaataaaaagccataagattgatactttttccttaagaacagaattagaattctcctgacagaattttttaaagcacattgagtgattttaataatcataaaatttagctgggcaaggagggaagctgcagggacagaaggtgactgacagatactgaaaagtggtatgacaggtattaatagattaaaggaggaagaattgttggagtactgtaggtagtgtgctagaaatacaaaaggtggtagttcgtaagctggatatttaaagggattgcagtctttgctgatgagactaagcatatgacgacaggaatgagtgtgagagagaacctcaagaaactgaaaggccagactctcagagggtgaatattgaagtcaccaagaattatgacagaagtgtgagtgcctgggtttgaatcctgatactatgtacttaccaggtatatgtccttgggcaagttatataaccttagtttcctcatcagttaaaatgaggataatgatagtatagttctctgaattatcaggagtaaacaatttaatacttatgaaactcttagtatgtggtatatggcaaatgacatataaatgtttataatattatcagaatcataataaccattattatttgtatgatccagtcctgtgtgagtctccgcttttcattcactagaaatttattaagcgactatttcatgccaggcattttgctaggtatcctgttaaaacttctgaattattttatttggctgttttaggcttcaggaatttcaagtggaacagaaataatatactgcagcctcaccaaaataaaagttattcttgaagtctttgccatgagttctccttgctgaattaaaatgctgtttagtaaggatacagacccagggggaaatggagcaaaccaaagcagtgattacttggatctctatactggacaggctcactgtagcaaaagagatgcttagaagcagactcagctgtaggacatgaaagagaatctaaccatatttttgaggcatggtggtgtccaaaatgtatggtgataggagatgggaagcagcgaagataaaaagttatccttgtggtgttccaacttgaaacagtgggttaatgtctggtagtcaggttaaacacagagagctaccattttggaggttggctgtcaagatatagacacttggatgttaggaaataagatagagatccagttactgagtaaaatcacttatatgattatcttctttaaaaaaaaaaaaaaaaaactatacccttaaagtctggggttcctaagagagctaacctaggctattcattattatttataaaaagtaccttaagtttgctttatcacctggccaataggcaatttcaccttctggctcaaaacacattttctccatctacacaaatgccaaccataatgttgcataagagtgagtgtgtttggtagactttagctaaaaatcagtgtaagtttgagcagacatggggaagaaaaacaatgtgatgtgaactttgttctctgtgtttaggcaagctacgacctatatctatgccagtggaatataattgggtgggggactatgaagatccaaataagatgaagagagatagtagaagaggtaagtgttctagaatttcagtgtaggctgggttgtttgaacaataagcaaatttaaatgttctgtaaatagattgttatggcttcagtggaaaacttattctatcattgactttattgtacaacaaaaccaagtaagaccaacatttgactatcttgacccattattaaacagatattgtctctgaatgccttctaaggggttccaggtacataagtatggtgttaaaagtaaatatctgattattatttgaaaggtaatatttggaacacaaggtcaggagtgtgaaactgcataaaataattaagttcagtgaataggaagagtttatcatcagtcctcatcggtctgcaatgcaacctcaccagttttgtatggaatcaacctcaaaatgagcattgaagcacatgggttaaaagctaatggaaactgggccagtgacttctaacaaaaaccatgtagaaatagaaaaaaaaaaaaccgtgcttttttttcctgttctgtttgctgctcagagttatcttcttacatgggggtgggctactcttgaaggatctaccaaaagtaagtttttatgttcacttatcctgctatagagatgagcaatagagagcaactgaaagtttccctactaaataggatttgatcaagtgtgggtatggtgggcccagtgggtcatgctgctactttgactttctgaagtagagagccgtaaggtcgtaggtggaaaataaaacaaatcaaaacaaaaaactattcatagaatgtaagttcactaagcttccttcatgatatgtttgacccgttttcttgttatttctagccagtatacagaatttattttattactgcacagatccgcagaccatatggacaagcaagcatgaatatctgattcattagtcttcttaatacttgttttatggagtgagcatttctgaaaatgttgataaatacaggaacattgacagattcctttatatctgtgtattcattccattttccaatcttcaatttctaatctcatttgttctatagaataaatcaagaaaagtataaaagagaaatgcttatcacatgctatctcagagtcactgttttgggacttcatattttagagacttttgttgatggggaggggaaccatgtgaagtactaagagctgactaccaatttaagcatagaattcctgaactaaatttcctgactattggttcttaatgtgggccttaacttctccaagcatgctaccttgcatgccacgggccggtgtttgttattgggctttggcaaaatccccatgagggtgattgttacaaattttataagccacacacctagaatttctgattcaagttccagaggtgattctaatgtagttggtccaaagctaaaacttggagaaataatctatcgactgtctattttttattgtcttatcataccaaataattaagatatactgtatttcactacatattttataagttaaatcaagttaaagttctgaaatgaaatatattagattggggcaaaagtaattgcggttcttgcaattaaaagtaatgggaaaaactgcaattacttttgcgccaacctaatagcacaattgagaaagaatggtaaatttggggtatttgtgtatttatattggtgtatttatctctttttatatagaaaactctctacttcggtatatgagcaatgaaaagattgctcaagaagaatacatgtttcagagaaacagcaaaaaggacacagggaagaagtcaaaaaagaagggtgataagagtaatagcccaactcactattcattgctacctagtttacaaatggatgcactgagacaagacatcatgggcactcctgtgccagagaccacactataccatgtaagtaaaatttcaaagactcttcaatacagcttttattggaagactggcaagtgactcttttgggtaaagtctaggttatttttatccttttactagattttcacaaaagagcctaactttaaagtttatgcccttaaaaaatgatgggtaattgatttttttcttaagtttatgtgttcaatgagttcatagttgtagcaagttggattttaatgggataacttaatatgcacaaaattgatggagaacaataataaatagctgattaatcatcagtgtgatactatgcaatgcacagatagctataaaattcaacattaaagatataattttaatatagtcatgattccatttaaaaatgaccatctattattttctagacatggagagtagggctagaggtaaaatgggaagacgtgagacaccattttatggggagaaagacatgctgagagtcccagtataacttaactgttgtgatgggtgggtgcagaaagtataagaggaacataggagaaatagagccttagtctttaggggaagtgagaaaaggcttcagagtggggagcatttgaatggagaataaaatatgagaagcagtattttagtgcgaaggcatatgcaggtgcgccacaaatgtgtgagaatgtggcatgttccaaggattttgtgtggcttatgattgctggtttattaacaattggaggaaatggcatgaggaaaggacagtagatgggcctggagtcataggtaaaggttagatgaggaactgtatgataaagtacttagtttctttcctgcagtaataaagagctattgaataattttgaactgggaacttgcgtgatcaaatcggcctattggatctctctagtgcagagcgtcatttgagagatcagaagcagggctattaagtccaggccatatggatgatgagaaactaggataatggccgtgtggaagctgagaatcatgttagcaagaacatttaatccacaaaattatgcatgttaaaccattttggttaaaaggagtttgttgtgtcactggaactatagcttcttattaggagcccttgaaaaacatggactgcaagtttttaagtaatttgaatgattgtgcttaatgcttaaaatatcaaaaaaattttaatctgcccctgctgtagaaggtatagcatctaggcattcaaaatgtgaaagatttaataacttacaattgagttgtttctctgagcaaatctcttaaatcatctacttattctatagctcttccataaaactagagtgtagaaaaatgtttttttttttggactatagtgttattagcactcctaggtgcctcattctttaccctcccttctccccagttacatactctcagaagtctctaagacactagtgcctgtatcagaatctgctccgttaaatgactgatcgattgaattattattttttccacagacattcagagtcagcctgaaatcagtactcttagtcgtttgaaaggggaccacttttgttattaccactattcagaagagctgtatgagcactgagcttcctctagaatctggtgttccagtcataagtaataccctgaacaaaagtttgaagatgagggacagatggcctattcgagagggtagttggtagtgagagatgaacctagagaaggaagaagagaccatcactttgactcagagtgtacaaattattaaaagtttggatttatcctgagagtagtgagtcattgaaggcacatttaaatactcagcctgctccattctgtcatgcatatcctgacagatgttatactgtgtgcggaaggaaagtagttaagtcttgtgaattatgaagtattaaattagggaagacagtaaaaggtgagccaaattggtaatcaggaatattgcgaatatttttgaggagtataaattgttaccacctttctgaaggacattgtttagttatgtatatcaagaatctgatctactaacttcacttctagaaatttattctaagaaagaaatcagagtccacttttgcctcctgtttttattatatgtcttgaatctgtaacatggtatttcccagatagttgacatctatctcaactaatttttgacagaggaccagcacagagtaaggaatattgttaactttgggggagatcttcccctataatgctgatacaccaattccagagtagaaggctgggtatttcctaactctgttctcaggtttagaagaagcaaaataatcgctaacccccaagtgcgtattggatatctataaccaatgttgtaaaagagagaactctaattggtggggtttttactaggctcttgagttcccttgaggatctcaccttgcccttatttagtgctttcacagttagcaaggaagtttccacatttgatatgtcttttgaacttcacagcaaccctatttgcaaataacaaaactcaaactcagaaatgatttacaaaagctgttttgcaaaaaaaaatacaagtactgttgtcaggactagaaccaaatcacctactccaggggtctttccgcactctatcctgttgctttgtgcatggtacacattccatatacagaggaatttgtgctttaatgaataaatgagtgcatttgaaaggcttgacttgaaaaaacatgtggccttgtatgatgatgttaataatgttttcagtgcctggattgatttcttttttgcttcatgttactatttgttaagttaggggaaacatactgagctgccgctgttataaaacacaaatagttatttagcttgatctattgctgggacaacagaatattatagttaacaatgcttggaccttggagacaaaacaacatacgcttaaataatagctttttatatttcacaggaatttctgttttatttttacctgtttatacatgcttatttaaaaatgaaaggcttttttcttatgttaaattttcctgaaaacacaatgtcagtatcaatctgtaatctaatcgctttcatgatgaaccactaatcttcatttttgccaattactcctttggataacatggccatgtttaatggaataggacttaagtggaagaggactatgaagattgagtattgcatttcataggcttctatctctgccgtaatactagctctatgtaatctaaagattttaagttaaaagttagagaaaatttagtatgaatttaatagcaagataatatcatcattaaatccccttaaacggcaaagtaaaggggtgtgtgcatgcatgcatatagtgttccttataagcacacctagagtatagtcttcactgttctgttgtggaaaacgtcccaataaaaatacacaaagcaagacaaatattgtttggcttcagggttcaactcattatcctataatgaagacttagaagtgtatgggattataaaatacatttttattaattccatatatctgatattctagttcatatatatttttcttaaacttatttaaaaggaaattattcactgtgctgtagctaccctagtcattgaccagctctttgccaccactttccttttcaacatgctattcccgctgctgagaatgcttttatctcttttttctcccaagaattcctgcctatctaaacctgaaatcacaaggacatcttccctgaccactaccctctgaactaaatcagttctcctattttctcttatcatccagtagtttttcttcaaaacctttgttgggatttttaattatatatttatgtgaacatctgcctagtgtctttctctcctgtacatggtaggacaggtatgcctatgttcatgatgataagcagggacaatttctccattttgttcagtactgtatttcagcacctagtacaaatgtagtaccttataagctctcaataaaaatgtcatgagtaagtgaattaatgagtgagtgagtaaatttgacaggaacttcagtggctttctcagtgtcttcaacctgcaaacatagccccctccatctcctaggtcaaccccacaggggcgaacaatgcaagaggattagctgccttacatcccctaccctacctccttcactccagctgaaaacttcagttccagctagttcttgcttgcttcctttccctgccatctcattacaaaggttccaatatgcccatcagccaagcatgttatgacatttttcaaaagagcataactttattttacctacttactgattctgtctgaaaatgtggaagctgttagctgccaaagccctcatctaacctgagagtacatgaagacaaggcagacagaagtttttgtgtggtgtgtgtgtgtgtgtgtgtgtgtgtgtgtgtgtgtgtgtgtgtgtaaaattcagatgtggtaagaaaagtctttaaagaataactgaattattctgaatctcatctttaaatcttgtaggacttatttttccccaatatgatgtgcatatgacaacttgctctcacattaaagctgctgaactaaattcatatacaaaataattacttaggccgagcacggtggctcatgcctgtaatcccagcactttgggaggccaaggcgggtggattgcctcagctcaggagtttgagaccaacctggacaacatgtcaaaaccccatctctacaaaaaatacaaaaattagctggatgtggtagcatgcacctatagtcccagctacttgcggggctaaggcaggagaatcactggaccctggaaggtctaggctacagtgagccatgtttgcaccactgcaccccagcctgggtgacagagtgagacactgtctccaaaaataatagtgataataataatagtcatttattttaagtctacatgctgagatgccagaacaagtaaaattggattatagattcaagcagtatgtaggtatactttcataaactgaatactgatgtaattttggatgattaaaaacagacttttagtaggtgttcaaaaatctggataattcctttcatgacattcaaacatttaggtggcctgtctttgtttttttaggatataactgcaaacattcaattgttttatgtctcataagtactttcagccactctggccaatttgtgaggttttgtggctttttttgatggagggaagaggggtagaactgttaaaaaacatttttatttttttttaatttagcaagtaaataaacattatgaaaatgctattctgattactttacaaatactatcttatttaaatctcataatgctgtgaggaagctcagttgctggtgttatcctcattttacagactagaaagctgaggcacatggattaattaggtagttatgtggtagagctaggatttgaacatttgcactctggctcttagcatactatattgcccctcaaaaaatagcataatttaacagaaacctaacaacagttgtatagtggcaaccacgtgtaaagcccagtctaagtgcagtggtatatacaaagactaatacaggcatatctcagagataatgcatgttcagttccagacaaccacaataaagtgaatattacaataaagcaagtcacacaagattttttaggttccctgtgcatataatagttatgtttatactatactgtagtctgctaagtgcacaatagcattatgtctaaaaaacaatgtacataacttaattaggaaatattgctaaaatatgctaatgattatgtgagccttcagcaagttattattattattattattatttttgctggtggagggttttacctcaatgttgatgtctgctgactaatcagggtggtggtagctgaaagttggggtggttatgacaatatcttaaaacaaaatgacaaagtttgctctatcaatttactcttcctttcacaaaatatttattagcagcatgagatgctgttcaacagcattatatccacagtagaacttcattcaaaattggggtcaggctctacttccaattctagttctcttgttatttccacaacatttgcagtgacttcctccactaaagtttagaacccctcaaagtcatccaggagggttggattcaatttcttctaaattcttgttaatcttgatattttgacctcctcctgtgaatcacaaatgttcttaatggcatctagaatagtgaattctttcgacaaggttttcaatttactttgcccagatccatcagaggaatcactatctatggcagctatagccttacaaaatgtatttcttaaataataagacttgaaatttgaaattactccttgatccatgggcagctgaatggctgatatattagcaaacatgaaaacaacattaaccttgtacatctccaacagagctcttggttgaccaggtacattgtcaatgagcagtaattttgaaaggaatcttttctttctgagcagtaggtcccaatgatgggcttaaaatattcagaaaaccatgctataaatagatgtgctgttttccaggctttgttgtttcatttataaagtacaggcagagttaatttagcatcgttctcaagggccctaggattttcagaatggtaaatgagcattggcttcaagttaaagtcatcagctccatcagcccctaacaagagagtcagcctgttttatggtttgaagctaggcattgacttctctcaagctatgaaagtcctagatggcatcttcttccactgcaaggcatttcatctgtattgaaaattctattgtttagtgtagccaccttcatcaatgatcttagctagatcttccggataacttgctgcagcttctccatcagcacttgttacttcaccttgcactttttttgttatggagatgccttctttccttaaacctcataaaccagcctctgctagcttccagcttttcttctgtagcttccttacctctctgatccttcatagaattgaagagagttagggccttgctctggattaggctttggtttaagggaatgttatggctggtttgatcttctatccagaccactcaaactttctccctatcagcaataaggctgtttcgttttcctatcatttttatattggaggccttgctttcagtatatcttggcttttgacatgccttcctcactaagcttaatcatttctagctttgatttaaagtgagagacgtgtgactcttcctttcacttgaacacttagaggccatcgtagggttaattaattggcctaattttaatactgttgtttctcagggaatagagaagcctgaggagaggaaaagagatcggagaacagcccattgggagaacagtaaaaacagacacaacatttattaagtctgttgtcttacatggcttctttctttaatcctcataaaccaacctctgctagcttccaactttgcttctgcagcttccttacctctctcagccttcatagaattgaagagagttagggccttgccctggattaggctttggtgtaagggaatgttgtggctggttttgatcttctatccagaccacttaaactttcttctgttttcttctgtgtcagcctgtcttttgaagctttgaagccaggcattgacttctcctctctagctatgaaagtcctagatggcatcatcttccactataaggctgtttcatctatattgcaaatgtgttatttagtgtactgttgttcatggcaccccaaaataattacagtagtaacatcaatgatcactgatcacagatcaccataacagatataataataaagaaaaagttttaaatattgtgagaattaccaaaatatgatacagagacacgaaatgagcacatgctatcggaaaaatggtaccaatagactcattcagcacaagattgccagaaccttccatttgtaaaaattgcaatcttcaaagaataaattgaagcacagtaacaggaggtatccctataatatttccactgctaatattactaatagctagcatttactgattacttactaagctccaatgctaagcacttaaatacagtatctcttggaatcttcaaaatgatcctatgaggttgatatcattatttctattctgcagaactgaaaggaactggaacacagaatttaccttaaagagctagaaaatagcagagtttagaaatgagtccaagcatcctgactccaaaattcacacctttgtgtgactaaagccatatctgctcataaggattttatcatctattagggaagacagagctattattatcacaataatggaaaaactgtgatattactaacatataaacattcataattaaatttacctgcagttataaaggttggtttgtctaacggctgcctgacttagctgcattctttcaggataaaagtaattcaaagaagagatcagttattttagtggcaaagaagccacctctaagccgtcacttgtttataacaaccaatttctctccgttttgactttattcacccagaagacagctgtattacagaatgacatgatgtttctcccaatcaaggtacatttagacatgttagagtacaacagtacactaaatattatcatattcatttgtatattctctgattcctatggatgactttattatttctaaaatgtttcatagtagcatttgcaaacccctacatgggaacagtctgtactatgaaaagtatttcccagtgggctgcttccctacagcagtgattcccaaagtatgggccatccttggcaaagggctctgatgactgaggtctgacccagaagtgacagtactttctttgattcttatgggcaaataacacatcacaaacttccattttcacttgtgactagatattgcttactagtaacctactaaatgagtttaaaaggttacaaattgaataatcataaaataatacattcatagaatttattgaatattctaatttagtattttttcagtatgcctgtgttttagttcattcttatactgctataaggacatactcaagactgggtaatttataaaggaaagaggtttaattgactcacagttccacaggactggggaggcctcaggaaacttacaatcacggcagaagaggaagcaaacacatccttcttcacatggcgacagcaaggaaaaccgcagagcaaagcgggagaggggaagccccttataaagccatcagctctcatgataaatcacaatcatgagaacagcatggaggtaactgctgccatgattcaattacctcccaccgggtccctcccataatacatggggattgtgggaactataattcaagatgagatttgggtgggaacacagccaaaccatatcattacgcccttagcccctcccaaatttcatgtcctcacatttcaaaagagaacttcccaacagtcccccaaagtcttaactcattccagcattaactcaaaagtccaagtccaaagtcttacctgagacaaggcaagtcccttctgcctaagaccctgtagaatcaaaagcaagttagttactgcctagataaaatgggggcacaggcattaggtaaatacaaccattccaaatgggagaaattggccaaaacaaaggggcaacaggccacatgcaagtctgaaatccagcagggcagtcaaatcttaaagctccagaatgatctcctttgactccatgtctcacatttaggtcacactgttgcaagcggtggggtcccacagccttgggcaactctgcccctgtggctttgcagggtacagcccccctcctaactgctttcatgaactggcattgagtgcctgcagcttttccaggagcacagtgcaagctgttggtagatctaccattctggggtctgtaggatggtggccctcttctcatagctctactaggcagtgccccagtggagactttgtgtggggactctgaacccacatttcccttctgcactgccctagcagaggttctcaatgagggctccacccctgcagcaaacttctgcctagacacccaggcatttccatacatcctctgaaatatgggcagaggttcccaagcctcaattcttgacttctgtgcacatgcaggctcaacaccacatgggagctaccaaggcttggggcttgcaccctctgaagccatggcccaacctataccttggccccttttagccatgactggagtggctgggatgcagggcaccaagtccctaggctgcacacagcagagggatcctggacctggcccacaaaaccattttttcctcctaagcctcccagcttgtgacatgaggggctgccattaaggtctctgacatcacctggagacattttccccattgttttggtgattaacattcggctccttgttactcatgcaaatttctgcagcaggcttgaatttctccccagaaaatgggtttttcttttctactgcattgtcaggctgtaacttttccaaatttttatggtctgcttcctcttgaacactttgctctgagaaatttttttcaccagataccctaaatcatctctctcaagttcaaagctccacagatctctagggcaggggaaaaatgccaccagtctctttgctaaagcacagcaagagtcacctttgctccagttccccacaagtttctcatcttcatcggagaccacctcagcctggacttcattgtacatatcactatcagcattttggtcaaagccattcaacaagtgtctaagaagttccaaactttcccacattttcctgtcttcttccgagtcttctaaactgttccaacctctgcctgttacccagttccaaagtcagttctgcatttttgggtatccttatagcagcaccccactctactggtaccaatttactgtattagttcattctcacactgctaataaagacatacccaggactcggtaattataaaggaaagagatttaattgactcacagttccacagggctagggaggcctcaggaaacttacaagcatggcagaaggggaagcaaatatgtctttcttcacatggtgacagccaagagtgaaggggaggggaaagccccttagaaaaccatcaaatcttatgagaactcactatcacaagaacatcatggaggtaactgcccccatgcttcaattacctcccactgggtccctcccaccgtatgtgggaattatgggaactacaactcaagatgagatttgggtgggggcacagccaaaccatatcagcctggtacctatgcagccctgacagtgcaatcatgttcatatcgcacaagcacaagtgtagatgatccagttttctgtggttttcaggaggaatgctctattgatacatcattgggattttttaaaaagtaacctatagttttcagtggctgtttattttcattataagttatcattagacttcatcactatcaattttagtttgttttaggttgcttgctttaccctctaatatgtagtgattcatatttacctataatttttcaagaatgatactgtgaatcatccatacccaacagtacttacagagtaatcgtctattggtatacctagttattttttccattgaaaagtagagataaagagatagacccaagggatctgttggcctgtcttagggaaccacagtcaaaaactgtggaaacccactacctagatacagatatatggttaaaagaagaagaaaacaatattggctttacttggttataaatataaaacagttttggtgaatgctagtccacaaaaaattagttcacttgtacttcctcacttatttatataatttgttctttttgctttcatatttaggaaggtttggtttttttattaaaaaaaaaatcaactatcggtactcctcctatccccccatattctcattcaccgcaaactggtgtacttataatggaactggccagactagaggatttaataatagaattactctttgaagatttaaagattcacaaatacaaactttcagtcccagataagatggagtacacacattttattttatttttcctgctactcacaaccaaaaattacctggagaaaatacattaactcatctaccagaagactctgaaaggtgcaaaaaaataaggcagacaggctagagacctccagacccaaggaagtgctgtgagttcccaggcttttttacttgcctcctgtattacctggcctgggtgttataaaagcctgcaacctgaaaacatcaataggcaccgacaaaatacagtctttagccaacggactctctttagccaacatgacagaaatattttaacaacacctgcctcttctcaaggcagaaaccgtgaaaaaagtcatgcttctcttccttcaccacaacaggcataaagaggttcaattcactaagaagacatgacaatcttaaacatgtatgcaccaaataacagagattcaaacagtagaagcaaaatctcccagaactggaaggacagattgaaagatttacaattaaggttggggtcttcaacatccatctctcaataattcatagacccactaaacaaaacaccagcaagggtacagaagtactgaatgactgtccaccagcagtttctaactgacacccaacaacagcagaatacacattattttcaaatgtgcatgagatactcatcagaatagaagttatcttcagtcataaaacaaaccttagctttaaaagaacttgaaataatacaaaatatgttctctgattataatgaaatcaaactagacatcagtaacaaaaagataacaagtaaatctccagccacttggaaattaaagaacatacttctaaataatccataggttaaaaggaagtataaaggaaaatgaagctgagtgaaaataaaaagcatatgcttagaggaaatttatagccctaaatgcttacatgagaaaagaagaaagatggcaataatctcagcccctacctcaagaaattagaaaaagaacaaaacaaaaagcagaaggaagatttaataaagataatggaattcaatgaagttgaaaacagaaacaataggtaaaatcaaaccaaaagctatgggattttttaatttaaaaaattgacgaacatctagcaagactgataaagagaaaaaggagagaagactcaaatgaccaatatcaagaataaaataggcgatatcactacaaccctcatagacattaaaagaatactaaagaaatacaactctgtgcctgtaagtttatcagttcagatgaaatggaccaattcctcaaaacatacaaactgccaaaactcacccaaaatgaaatatatctgaatagttacataactattaaagaaatttaattaactattaaaatttccaaaatatcaatacagaaatactttaaaacaaaagaagcaaaaccacagtactaatatttttgtattgattgagtgtgggaataaggaattttgctttcattgttatgttctgcgctgcttttaaagtgttggaagcctataagagatttgatgtacaagacttgtaacttaatggaattcctaagatactgattaaattcatcagttttattaattttgaaaatattgtttaaatgtttagaaatttttatttcctcaatttttaagttttaaaatttgaaaactaaacaaacaaaaagattcacaaatatgccctcactcttgagaaagatttttgctccctgtataaaacagattactgataaactgaagccagccctttcagcttcacatttgaacaaatgtgggtctcagtctgctacttcctgggtagaaaatgactgccaggaagcaaaacacaaaatttggctcaattagtgatgcaccatgtaaaacatgatgcagaagaattgaattataaatttattaaatttaagtcttatttttaattcctttttgcctttagggaaaaaaaatacacaaattctaataacaggcccttggcttggttggtaagttcagtaattaaaaactatttggggacatacctgcctttagttgctttgatcagagagcgtaaagaagccccattcccttttatgttgtagacgtttgtctcctagctttatagcctcagaaaatgtcctcaaattttgtaggcaattggctttttttttgctcccataatcaccctactcgtattaccttgccaccataactcatttaatcagacatctcaagtttaataaaactgtaggtagaattatcttacccctagaattctttaaagcctattctgattgaaggtcataacctgtaccaaattattttcttcacttaactcccacaatatattaatattactcccttgatggtttcagcactctcagcctccacaaaactatgggtataatgatttgctgtatgtactaaaattatccaaagtttcctcttaataaatgatattaaggtacaataatttattactgttagattctagttttttaaagataaattttctaagaactatgttaaattgtttgcagccattatggatttttcactagttttgactctgacagcaattggcaatggaccaaagtgcataagctcaacctagagtctcagttctaaatgatactgctaaatctgtctcttaacatttctacaaataccagggtaatttaggaacaggatcctaatagacttcaatccaaaacaacttggaatgctgagaaatagatcaatgtttcaaacccatgttctttatatgtgactgattttaggtaaattagtgtaaactttcctgccatagtaaacaggagaataagttgtcttcccatggtttcttttattttcataaatctagagtggtcccaagacataatggttcttgtgtctgatagtctccagataagagttcagcattaagaagagaattgccttttttaaaattcagctataggtcagctatatatttaaatatatatagctatataggtcagctatatacttaaatcagctataaaaagctaggcacatttctgaacctcagtttctcataggtaaaaagaggataagactacttacctgttttttttttttttttcagaattaaatcacacgttgtatataaaattatttccactgtgctgagcacatactagctattcttaactccatatagaaagaaaattagttactctgcatgtaagggaatttatcttctgatgagcaaatcaggaagccttctaggactaaaacagaatgcacttcttttgggcattaatgagtatatccattgaagtacaaccagggaactagaatctctaagtggcatggaataaaggactagatcttattcagttgaggagctggcaaagatgcctcagcagagccagtggttgggaagaaaatctagacatgaagtgaggaagaacaagacaaactagaacccatgagcacaaaccagagcatttcctccaacttcaacaagaagctggtacccttctccatggagattcacagattcatggtcccatactcaggtgctgaaggaggagatccgattggagctgaaggagttgtagacctggctgctgactcacaccagtaaggcaagccaacagaaaagtaaaacaatgtgtatcagctgcagcagtgactgacaccctgccctgaccttcggagcaaaagagctgctgctttacttgtattctccaaaactgacacaaatttacgtagtggccaaccctaaactagaaccatatagacaaaagaattctaaaacacatagttccttccagcttagctaaattgatgcaataggaaactaccaaactgaggtttccttctctgtggccattatcagtgtttactgtgtaaaacctgctttgaaaattctctactgggagtatgtatgaggttcagtggtaaaataaaaatcataaattatcataaatctagagtggattcaagagtgtagcctacctctatgagagtaccatctccacaacctacttctttaatttaccaaagcatatactgagaaatacatcttagccaaatgttgaatcttcttcacttagttgcattttaaaataatgtcctcaatttttatcatatggttattacaagaaacagccatatgaaatacacttcttcatttgctataaaatgttttttgatattgtattttctatttctttgtaccttccatcatatatatttttataattgggtaaaagctttggctctgtgtggtgacagtatatgtaaagatctgattcagtgtctggcactatgatagtgcacaaatagtatacccttcctccaacagtactaccaaaatgtcctcaccagtgggctgagaacaagcaaaatgtaatctaggtgcatttgaggtaaccagttctgaagaagtggcagcaaatatcaagccctccagaaatttaattttttatactgagattgcgtaagttgcctcctttcttttactcagttttctcatttacaagacaagtgtagcactgcagagaggactatgaaaaatgccatctaaattgacagcataatgatgatttgattcctgctgcaagcgcagaagttaaaatatctccccatcaagttcttttttcccttctgttagataaaaccaattttcctttttttagtcttaaaatcatgttttactatatagttcagtattaaaaggaacagtctgaattatatatctcaattattttataaaataaattgcatatagtgacttttgatactttttaaaattctatttttatacagtactctttgaaaaatatttctgttatgaaaaaagtctctaaatcaagaaaactctattaaaactaccagatgtagaaacatctgaagtagttgtgttggagagcttgtctattatataagagcaaaaatatcagaataagagtttaacagaaacgtagtattaatatgataaagatatttagataaaagctagcattcttggaacaaattatactgacacagactttcataatgagaaatatgtacattatatcagagaaatcaacctaaaaataaagttaaagtaatcagaaaaaaactttgatttcagattcttttacaaataaaaccattaagtccacaaccagaaaagtttttcagtaaatatgattcagtcacatcattgctgacagaatcatcaatcataccataattgtgacttcatttgagattcttgggtttcatgcatctctgttagaggtgattctttctatattatttattcctctatttcttttacacatagtttatttccttgtcattcattagcctgcaggtagcaaatctggtcctctccattttttctggttataaacatttctttgtcacaaaagacaggcaaatctactcttatttctctgacacctaaatttcaacggtttctgtcaaacagaagtgtcaggagtaggagctgccctagttctgcttttcacctgttagaacttgctgcctctgtctcaagtgcaaatctatgttaattgtacacatcaatcaggcaccccaaaatagctgtatctaatatggctggtgataagttatttccatacatggtggaattcaaacataaactaagtgcttttcaatgaataatctagcattcagtgttaagactgacactgattacaggtatacatataatatttcctaaaacatcaataattaggtctccattggtgatcattaactggttttccattcatttttaaattatgatcctggaaagttattgttctatgagacatactaagaacatgtggtccaaatccctgatttcgcagttgaggaaattgaggtcaagagtagtccagtagcttgatcaaagtcatagagctggaatatagactgaaatatgaactgaaagtcaggtctcctgattcctaccatggtgttgcttcattggtaatgtgtgttcctttcttgctgagaaatgagcattctaagtgtatcactccaactgatttgttgaaaatagactgaaggggccaagggtaagtgtggaagcggggagacaagataggatctggtcaattcaagtgagagatgagagtgacttaaccctgggtgttaaagtggaagtggtgaaaaggggttggactctggatatgttttgaaggtaactggacaggatgcgctgacagattgcatatgagaagccatgaatcatagcccatacctcagtgtcccacacataggtggtgagtaactattcaattcatgccttcaacagataattgtatgtcgcatcctgtgctaggagctgagtatagagtggtgacctaaacaaatggtttctgccttcatagaactaatatagtaggtaaaaaccattccttcagaaagtgagccaagtaattccaaagcattgcgtagtattgaggagtgttttgggtggaaaatggcataacacaatgaatcagctcaagagagtaaagaattagtcaaaaggcaggctggatccatgattttctcatcagtattgacacagggttttctaattgaactgagttctgttaataggcttgtactgaaatgtaattgcagtcccatctctgtctacttaggctgggccttataatattatcgtaccttaatttctgtctcaattgcaaaattaagatgttaccatgagccttcctttcatgcagatgttattataagcggttgcccagaaactcctgtaaatcttcttttataacctacagagcaatataacttgctaattaaaataaaattgagaaagcatgaaaattagagattgatgagatgttattggtttgaattatctccattgatataaaagtgtttttctcactgataatctttctgttttggagaatcctttctcttcacatagcaatgtacttgcatcacctgtcatgagatgttttcataaatggatgtcttagtgccagaagcactttttctctctctttaattgttactatgactacataatacttacttgggaggcagtaatgcatgtagtaggagtataggttttggggttgacagacctggctttgaattttgactctacccctacctgtgtgatcctgagcaacttatttatgcattctgggtctcagtttcctctttcttaaaatggggttaatgataaccactttacatatgtattataaggattaaaatggatcaattacatcacttataaacacttgtaagtgcttaatattgtgcctgacacataataagccctcagtaaatgattattattttgagctaaggatggcagttcttatttcccaagggtattgattcatgttagccttcctgaatattttccaagtaatcacttcccttcttcctacattaccactgtgtaggaacaggaggactcaccttatgggatcctgcatgagagtcaatcacatccttccttcagaatctgatacatatgacattctttttgatggaacattaactctgcccaacctaagtagttgtagtttgactgaccttctctagattcttaccaattactgtctttttgttcttatttgactgctaatttactggtttataaagcatgcttatttttgagtaagtgtggagccattttcagttatacatgtaccccgatcctaaaataaaagtttaaaaaaaatcaggtcgacctgactgacagaatccagagctacctcatcccactctaatgaaagacctacggtgtgtgcagtgccacatccttcaccctgattgactccaagtttttctttcatgcaccagaatgagcaaggccaccaacaacagcagacttaagttctatgctgttatttcttataaatggaaattttttgacttaatatttggttctattgtcatcctatcccatttccatatatttacttttttcttcctacatacaataattagaaagttaagagaaaacattttttgtaaagtatttaaaatctcaaagagttttacttgtttatttaaaaaaaaagtgtggaagcagctatcatctaaagtgtttcaaattgttaagcaccttcttttcttatgtataagaaagaagctattggtttgactagtcactgaagaaatcttggaactttgcagaaaattacagtaagaggaaattgctattactgcaacaagagagtactttgattgcaaatttttccttaagtgtgtcaatttgcaacttgagaagaatttaatagtagctgagctttcaaaatgtaacacagaaactgatttttttcacaattaaaataagtgcttctgataatttgaggataagaatgacccaaattaccctgcccccacacttctccatccaaaagagtggggaatgaagtttgaacagaacatctgtggacagaatgaaagacaaatggtcttttcaggcaaatgtctgaaaaagggatctttcatagccaaacagaatactgttgcatgcatcgccatggttaagaagatcaaaaatactttcataatagccttttattttagcacattctatttttatggaaagaattatgatttcaacacattcattcataactcatataattattagcataaatatcttttgacacagatttaatgtacttttgccaggcatattgtgaatttaaatttaaactgttaaatgcactaagacaatctcagtgcaagtagtgctgaaggagattggataaaaggaaattcttcttatctaccaaaaggaatggcctattaaagaacagaattttcaataatgtattatacatggattcatagacttcttcaagttacaacaatcagctaattaagattacaacctgtattctttgctgatggtttgttcaacatccattcacataaccagtatttattgagtgcctactgtgctaagtcttactctaggcagaggacaaagcaatacataaaacaggcagaattgcccttttttaatggagtttatatttggaggaagtccaggtgataaacaagaaatataaatacttaagataatgctaaatgctcagaggggaaacaaagctgggaaaaagaacagaaagtattgagggcaattgggataacaattttggacagggaagcttgggtagaatttactaaaaagaaagcctttgtgtaatgacttgaaggagttaagggagtgagccacaacaacatctgggcaaaaaacatttcagacagaagaaacagcaagggtgaaggtcttgggatgggactgtacttggcataatctaagaacagcaaaggtagctggaacaaaattagcaaggggagagcagtaggcaaaggtaacaggggaccagatcatgtagggccttcaagtcattgaaaggatataggcatttattcagagggacatgagaaaccattgatgagttttgcatataggaatggcatgatttaaatcatattttaaccagatcactctggctcttgtgctaaaaattagagggggctggtcttagtggctcacacctgtaatcccagcactatgggaggataaggcaagcagatcacttgagcccaggagttcgagaccagcctggggcaacatggtaaaaccccatctctactaaaaatacaaaaattagctgggcatggtgctgtgtacctgtagtcccagctactcagaaggccaaggtgggaggatcacttgagcccaggaggcagaggttgcagtgagccaagatcatgccactgcactccagcctgggtgacacaagaccttgtctcaagataaatatatataaatatatatatttatatattatataatatatgtataaattcataatatatatagtataaatatattagagagggtaagagcagaagcagggagaactgtcagggggtatttcagtaatccaggtgagagattgtggtggcttagaccagggtggtaataatagagctggtgagaaaaagtcatattataaatacattcattgtgaaaacaaagctggtaaaacttgctgatggattggctatggggtataagagaaggaaaagagttaaagttgactccaaggttttgtacctgagccactagggaggaaaaaaatgtaattactatttaataagatatagaagagtaggaaagaagcagatttggctgatgagtgatagatatcatgagctcagttttgtacatattaaatccactcagttaggcaggctttagctcagtgaagaagtcctggctagtggtatgaattcttaagttgctaaaggtcagaatttatggaacattcttagaaagttcgaagaactttcacccagatgctcactataataaacagaaagtgctagtgaaggcattagaaagattttaataaatgatgtttttggaaaaaatgaagatgggaatttttagagaattggacttcaaaaatgctaacaagagaaatccatttttggtgatcaataagcgttacaagcttgtgctttaaattcacatacatacacaccctcacactcaccctaccctaaacacatagcaataaaatgaaataaaagatatggtcatggtcaaaaatgaaatctaatctccaggcaccagaaggaacaaaaatgctcagtgataattgggacctaaagccacatatcttaggcaccgagtccagaaaaagatagagatgcctgagagtcttctctaatgagtatcagagaaccaatggacctcagctatgtcggaaatctaaaaattgactcacgaggtgtaaccaactgggaaggcaagcagagcttcctcattcatgagtaaggaggttaaagatgcagttactaagaaataaataaagatacagctacttgtataaaactgaattcctaggtgtctacaagtaacaaaaacagatactcagaaccatgggccatgcctctcccacttggatttcatggatggaactgcaacccattgccaccactaaaacgcctggttagtgtcccaaggaatggaggcagagacagcaagacgcttagttaagagggatgagtgcaaaaagaaacatccctccaggaagaaccttccacccaagctaaaattccaaagcgtctagagaaaattaatacttttttaaaaaaggcaataaactaaacaatgaggtgattttcttcactaaatgcaaattacaagaaggtcacaaaagcccttaaaatacatttttaagtaaaaacaggaaggttaaacagtggatattcaaaagagccactatcaactagatacactggaaatgtaaaatatatgaaataaacactctatcgataagataaactttagattagattagatacaatcagtgaaagaattaggaaattggaagacagtaaaatgaattcccctaaaaggcatcgcagaaatatgaaaggatacagaacatgaaggacacatggaagataaattgagaggtaccaacatatgtctagagttttaaaaaggggctagtaaagaagaccatttgaagagattttcagaattaaataacactttcaatacaacacaaaaattgccaaatagagtgaattagataaattgtaacctagacacataatagtgaaactgcagaatattagggataaagagaaaaatattttagaagctacagagaaactaaagacagattaaaacaagcaaatgacagtgtaactacagatggcttaagagaagaaaaatagatgcaaaaagaaaataaagtaatacattcaaattgctgaggcccaactcagaattctatacccagccaaactattattcaagaggaaaggattttcaaacattaaaactaggagagtttgccactcacagactgctgtgaaagaacttctaaagaatatacttacttgagcataaacttggaagaagggtaatctgaagctaatatgaaatatacatgaatgagatatattatgaatttttacctcatgagaaatacacttaccacgaatgcaaagattctaggcctctttcatttttcagttagttgttgtagcaccttatatgatcagctgtgttatgaattacggtcatatgtctgtttttaatgtcttgctcttattaaatttgcataatcttaaaactggaaaaaatgtaccaattaaatttctgtcactgacaatgaataattccatcagttctgctagaaaagatgatacaggatgataaatttgcacctcaggggtgcttactaacactgtagctgatgacataaggaaaaccctttctggagattatttatgtccattatttatgaataatgaacagtttctaatataagtttgtaagggatctttttgaatgtgaggctcttttggatgtccccaagaccacctacatgttcagtgatttgctagaagaactcataggactcaacatatagttgaactcacagctaggatttattaacagtgaaacagcaggaacctacagacagatcagtaaggaaaaaagacacctgtggaatctagaaaaatctatctgcaggcttcctgtgctctctccctcccatgataggtcacacagagcatactctcctcccagcagctaaaattcaatcacatgtgtgcagtgtttctgtccagggaagcccgttagagattcagtacccaaggatattgaattgggcatgtagacatcctctgcctagcaactaccaaaattccagacttccagaaggcaagtgaataatcagtgccccatgtgggcaaaataatcttatcatttagggaagcttcttatcagtatagggaactgtttaccagccaagttcctagatgccaaccgagggcaaatactgcaagtaggcctttctaagatggcaacctcaggcctgctacagtaactcttttctgcacagagacctaactgtatagttttaatagattttcccattacttccaaaagcatataatacaattaactttttcattttagaaaatgtcaagtcaattggaaaaataataaaatctctcttaagagaactttattttaatatttataatatctttaaaagacatctaaggctttgcttctttgaatgatggataaatctgtatttaatgtcttggagttttcaggtttccagtgcactgattatactctgcagtcatgatctttatggaaatatatttataggaaaagaaaagataatcttgttaaaaagaaaacctggagagtgtaaaatatgtttcatgtagatttttagagtagacattcaggttctacagaatagcatgcaaaaagcatagaaggtacattatataacccagttctttcaagctgtctgtaatctatgtagctttctaaaaacaaaccacctccatctttgtcatttttcaaaataatgagctgtaaaactataatgattacttgcagaaatacaaagggaaaaaaaaccccaatcagtaattttaccatgaaacaatgtagggaaaataactatctgtaaatgagctatacttaagcacactagcctgagttattatttgagttattattttgaagcaaagtgcattcaagaaaatcaacacagcataatgggttttatcttttatgctttctctcaaaatttgtgaatttctataaccatgcatgctgcaaagtttgatatgtgtgtgtgtatgtgtgtacacacacacacatataccacatacatacatatttataatgctttaacacttaggtgattatttctggaaagctttgtatgtcagcaaattatctgacccttatctttaggactgatacacatccgtagtactatgttcattagacttatataaatcatatacagaacaaaaattattatataagtagaatattatttaatgagcaatgatactaaataataaagtatcacaaaacatgaatttattgtgaaaaaagaccagcaaattttatataagcaaaatccagttgccccttatagatatatctttgtaaagaaaaagaagaatctgtaacctgattttcattttgaaggaatatctgtgaattaaaagcacacatgctatctctgttcccttttagctggctgatcatgtgaatgtaatgaatcttattataccagtgaacaatatggcttagtagactaactggagccagtgatgtgtagtcattaattgaaagttagaccaatcaatatagttgtgggtttttctctagacatatcaagctcttcaggtacttagcatggagtgaacagacaggtaggtttaactgggatggatgtttagcttggcaagtatgatgcagcgagcatggtcaagggaacgattataatggtatcccatggaaactaagaggaaagaaagaaatacaggcacaagagggtagttaggtcaatgaactggatgcctcaatgaagtttttttttaagtgatgacatgaaggtattagagactatgtaaaccatatgaattagatacagtggctggtgtgtgctttagatatcaaacatatgattatgggggtaggtagctgaggagtggggaagtaaatgttattagaactgaggaaccagggtgctgacatcatctacatgaagattagtcaccaataatagtgacagaagtaggcatgagaaaaaaatattgttccaagtgctgaaatatgtagggactaaggaagtaggagaacagtaggtgatggtggcttatgtaatagaatgaacttcatgtgaacaaaggatagtcatattttcctgcttacttcattagattttgtgagactcaaatgagatactgtctggcaaaccacaatatacccgtgaaaaggtacaaagtagtgtgtatgtgtaaaagcctttagttttaccaaatgctttgtgccctgatttctctgcctacaaaatacgggtaaatataatatcctttcctgcttcacaggagattagaaagttaagtgacatgatgtatatgaatttgttttgaggctttgtggggaaaaagttcttcccctaacagtgtttagagtcatcatttagctcttgagagttctgtgtagcgtgctggtgctctggatcacaccctgagtatcagataacattctttttatctttgatttcagacatttcagcagtcctcactgcagcacaaatcaaagaagaaaaacaaaggtaagaaaaggaaatgaaacctttacctgcttattttgctctttgataatccccaacacacttcatccatgccctctttcttgcctgagcccagtgtggtttagaagagcacaacccccttgtgcgaaagctgccagcttcttcttcagtgcaattataatacaaggtaccttttacaacaaatgatctcaataagttttgagagtggtgttacatatttctgattaagatgtgtgtcacttatgtgagggaaaatattaaagatttttatatttttctagtctaatacaatataaaaatttttaagattttcaagaactcatacttctttttggtatctatagattaatcctctactttcatacctttgacaaaattgaaagagcatttccaccctttaggtcctatagcaggcaagagcaaaagacgaatttcttgcaaagatcttggccgtggtgactgtgagggctggctttggaaaaagaaagatgcgaagagttacttttcacagaaatggaaaaaatattggtttgtcctaaaggatgcatccctttattggtatattaatgaggaggtaagataaagcaccttttgttttctcatccattctctatctttaatcaaaagaatcattttgagacttatattttaaaatcgtataatcaccttaaggccaattcagtagacttctgctaggtatttttcaatccaccctcttaaaatgattgcatgttggggttctagaaagatagctgtctcaattatgctaatgtagcaacatatctgaaacacagataaagtgtagtaaaattctgtatatctaaataaaaatgcgaagctaatccaagcagtagcttaactaaaaggattatatgtggaaatttgacattaatttttaaatgtcttgcttttgttcaaaattttacacttttttctggttttttttttctttttagaagtggggaaggggaagccctttactaatttaagtaaactaataccacctgaatttatttccatttttctttaaaaatgatctagtagactagttttgaaaatctgcaagtattcatttcacttggcccagtgggggggtatatatataatacatttaaattattcttatgattttctggggtgttttaatataacagatttatatccagaggagtcatatcaaaacttattacgtatcttgacagatatgccaaaaacatttgttgatattccctttattctgcatttgcttttattcctttgctatagccatctactagttcactttattagttttttaaaacaatgatttctgctatttccttattttataaaaaatgtacatggcttaatgtagtgtgctgggtgaatagtccaatactattatgttaagacattcatcaatttgcatttgaatattgttgaaatataatttaacaacattattatgcctacgattacaaaacataatatctagataattttatgttccctagacaggttataatgtagtgttatgttgtgtttaagagtagactcagaaatcataccacctgagttactgtgccatagtttcttcatctgcaaaatgagagtaataataatgcttatcactggactatcatatggatgaaatgaatcaatgcctggcacatactgagtgttcaataaacatgtggtaggctgggcccagtggttcacacctgtaatgacagcactttgggaggttgaggcaggaggatcacttgagctcaggagcttgaaaccagcctgggtaacatagtgagaccctgtctctacaaaaaattaaaaaattagccaagcgtggtggtgcacgtctgtagtcccagctacttgggaggctgaggcaggaggattgcttgagccagggaggttgaggctgcagtgagccatgattgcaccactgcactcagagcaagaccctgtctgaaaaaaatgtgtgctattagtaacatttttcaaagggacctctcattttatttgtaaaatcttgaattaatatttttctatttaatgtaaatgtctatatcacctatataaaaatatttggttgttttctgtacttttgacatttttgtggcaaatcacacaattacctaaaataccctctgcttcgctaagtgtgtcttattttaaatgtaggaaacaagccataattttacctacagtttcatttaatagatatatattaaatactttttatatgccaatcaaatattatcaagatatagtatctccatgtttctctttattgtaaggtcacttgcaggtttgtctgccacatactagattatatcctgtctttcaaagtttaagtgatgaaaaactgtggcccctttttgttgaactaagtttcattcagcaagttattgttactgttagccttgtgagagatgagtgaagaattctacagtatacattgcaagaaatacctttaatatgataatatttttaggagaaatgtaaaaatccctcatcacatcattatggggagataataactacctcaaaatattttaaattgttcaaaattttaaatatttacattatgaatgtcaagggtaaagtaacatagaaattaaagttgggaaaaggatttaaaaatactgtcttgtccttactccaagattggaagaaaaaatattcaaatactgaaaaagtttaatactactctttttcataacacatattcagtcactatcagtagcatcagatttttgttttgcgtggaagcttagcagtgaaagcagtcatacaaatatacaatctaaaagaatcgagaactctttttttcctctgtgatagtggatgggagtataatctcacttgaacttgatatataaggagctatggatatagcacagatcaaatgaaagttagagatagtaaaactcagaggagcttgatcatgagcagaacaagggatacaatgattaaagcatttagcaaaagatagttttagcttagttgggataactcgtatctaacataatattttggataattcttctgtcttgtttttccatccagcattagagagagcaggattttatggattttattccattttccaggtgaaaaatgacctttatatatatatagcacataccccaagccagatatttgaaagtcagattgacctatttcatttgtaaactcttgaatgcacagaataattgttataagacgctgatgagcttgcagagaagacaagaatacttatatactgttggtgagagtataaattagttcagccattgtggaaagcagtgtggcagtacctcaaagagctaaaagcagaactaccattccacccagcagtcccattacagggtatatacccagaggaatgtaaatctttctaccataaagacacatgcacgtgaatgttcattgcagcactattcgtgatagcaaagacatgaatcgacctaaatgcatatcactgacagattggataaagaaaatgtggtacatatacaccatggaatactacgcagccataaaaagaatgagattatgtcttttgcaggaacgtggatggagctggaggctattatcctttgcaaataaatgcaggaacagaaaaccaaataccacgtgttctcactcatatgtgagaactgaataatgagaactcatgcacacaaagaagggaacagacactggggcctacttgagtagggtggatgggaggagggagaggagcagaaagaataactattgggtaccaggattagtgcctgggtgatgaaataatctgtacaaaaaacccctgtgacacgcatttacctgtataacaaaccttcacgtgtacccctgaacctaaaataaaagttaaaaataattaaataaaagatcattgttgcataattagagaaaatcaaatttgataagagatttgttggaggaaaattgaatcagtgaacatccctatattttacatctgaacattaagaaaatagaaaattgtgaattacaaaagtggactacatttattttatatgttatagaagtgtatgtatgttctgaccagaaaattagttataaaacacattccactttgagaattaaagaattttccattctcattttaatatgaaaaagactttttaaaagttctatactttaatttgtagtattctaagtgttcaaaatatatcttcaatttatggagtacagcaggtaagcattgaattcttatctctaaaatgtcaaatttaaggaattaaaggaacggatttattagtacagatatctaagccatagttacagagtatcattaccttcacacctttgtatataataaactaaccaagagtcttggctcttcaggatgaaaaagcagaaggattcattagcctgcctgaatttaaaattgatagagccagtgaatgccgcaaaaaatagtaagttgattttatttgggaagagggaacgatagtttttttttttaatttccagcttttaaattataggttgctcatttaatgctttcacattgaggtaataagaaagcagttttgtgggcagaaaattgaactttttactgatttctgtcaccatgatagaagcattatatatgtgaactcgggttagatgttgaggtaattttgcccgtcagaattatttggttcaaacttatttcccaatttgtaataaatgtactttgtttccttttgcagtgcattcaaagcctgtcatcctaaaatcaaaagcttttattttgctgctgaacatcttgatgatatgaacaggtaaagtatttcagagtatgtagaaggtcagtgaggcctagaattctaaattttctacagtaattcttagagaataatgtcactgaagtttctaggtcaatcagtttaaaataaaatagacccagaatagctccatgcagccatatctaattttaaagaacatcatttaaaaagtcaaaataaactcgttaaatatttttgtcaagtttaccaagaccatatacagacccaaaaaaatctaccaccaaaaaaaggggattttttaagttcatttcaataatatgtcttaaaattgactcccagatgggggaaaaagagatgtctaccaaaaaatcggactttttgaagtactgagtatttttgacagaatattcatctcaataattcaggcctaagaaaaattagtatttctttctgtcacttttcatctttcacctgacaggaccacaaccaacaaatcagatagctcagtggttacttggtggctcagggaaaacttatatgtacattttttttcttttctcatcacctaccacattctgcttcatgttaatactttggcttttatgaattttgtgctttcttcctttctctttcctttcccctcttccttttctagaattatagaaattgagcttaagattcaaaattttcctcctttctataacttactagccagtacatattacaaatataacttgcctacagttagggagaggcagcatagcatcatggtcaggagcatggactttgcaaccagactctctaaatcccagctctaccacttaatagctgtacagccttggacaaagaacatgacctcttcattccaatatagtaatgtccaatctatacaagaggtggatggggctaataaccagcccaatctcagctctacactgattagctgtgagaccttgggcaagaaactgaacctctctatgctgaggtattagccctttaataaagtgaaaataagactgacccctatcagtaagacttttataaggagtaaataagcatacataaaggacttagaacagtgcctgctaaattataagtactatataaatgtttactattaatatatattccttttatatacgttgggttcttactccatctacctttctctaaaacaattgtacccaggcatttttaagcacaaaactgtatagctgcataaatttgcttgaacatactaaatgaacacttaatgtccttttataaataatcttgttctttgacatttgggaatacaaacatgttttttttttttcaaagcaaggatatgaatacaagtaaatggcaaagaaagatggtgttgagagcacttgattaaaacttttattactaataaaggaattgagcctttcgtatagtttccataatcttctcttaattcatataacttatcattcttgaaatttcacaccaagctataaaatttaaatagttttttctccttgttctcaaaatgaaaatatttattcacattcacatggagaaggagaggtgtgatactccattttatgttttaattattttataattccactgttctagtacttactatccattttaccatatgttaagctcaatacccttgggataaatacgaagaattttcatcatgaccacactgaaattaagtggcatacatgagcatatcgtatcttacaagatggatgcactagaatccagccaactccaagaattaatacaatgtaatcattcacaatacatgctaattgggatctttttaagcttagaagttgcctctttcaaagtgcattttatgaactataaaatccttcttggccctcattacccaccccaagttagcagtagcttcaaaaggatgctgatgtcactgctctttcctaatattttgtggctgtatctggttcgggatatcgcagaaactaaaccaaatttgtgtggttcattttgttggttttctaagcaataggtgaaagaaaaaaagtgaaacattaaaaaggccgtctccacattatacatttaaaagtgctgttttatgtaaagcctgccatggcccactacaactttaagaatttaattgtcccaaaatactgaattttattttaatttaattaaaatggatttttattgttttgctttgaattttgctttctaaaaaataaccctattcctaatgtctactttcaatgggaagatttttaattacttgttaatagaagggggaaagagtcagtgctacaaatattcacagaggattaatgatggggaggaacacccacctacagctttgtcaagtcacctgactgttacataacagcaagatgatctgggtgttggtttgttctatatgtaatcttttaaaagcatgtatctaagccttcaagagattatatatttataaaaattattataattatataatgtatgtgattatttcataattttttaatatcatacctacttcttatgaaaatacaccatgtttcagagaaatatatttttctgttcctcatttaaaaaaaacaaatgtaatgctggtggtgacaggacctagtaattggtgttaaaaagttatccttacatttaattttcttctgtaaaatcatacacatatatatatatatatatacacacacacacacacaacaaatatttatatatgtgtatacatacacatacacatagaatattaaaatatcaccttctattttgagaagcagtaagtttgattgtgaggtcatttgcaaaaacacttttaggcaccccactactgttcatctgtttcatcagaaataagcactgaaacattaaaaactgatttttttcttgtctgtgtaaaatctgtggggataaaataaaacatcatagtactcaggtattctgaagacttatttactgaatttgtttggcctatatattccttaccatgtcagtacacatgttcttgtaattgtgatgactcaccaattcctatttggtaattattatttatacatttctctcatggttctttctcttatttccctccaaacacattattctttgtcagttgtgaatatctcctttgaatgtttgctataggttcaatatcaccttacctgtattttcctattttaaagcattggtgatatggtaaggtactgactgaatttagacctgctattaaatatcttcctcataaatatattgaatagattctaaattcaatattgtatctctgaccatcttacctaaaatagccttccctcatccgcagcatctttggcattctaattttctaacttgcttgcttgtctgtttttaaatagcatttgctactatttcacatatgtttatttgcatccctgtttagtgtttatctccgtcactaagatatggaaatcatgaaggcaggcactttgttttatctctgtatcccaggtacctggcacatatagctgttaataaatgttgcttgaatcagttgatgcatatgtgtctgctttcataataacctaaaatattaaattataactgtaacaagtaaatcagtaagtatcttctagtttaatcctaaaggataagtttatccaagatagcaccaacaattgtgttgtatttagccccttgtggctctacacagtggcctgagtatatccacacactttctaaacaatttttcttcaattaacaaaatttttcttcttaagaatagtttaaactttcaattgtcttgtgaaacttagtaaatctagagttaattgaaggcagaaattacgtcttatttatttccgtatccctaaaacatagcttattgttcagcacatagcagacacttaataaatgctgttgaagtgaaaaattgagcaagcccctttttagtttcctaatttatttcttaaggacctctttgttctttacatttctgataagatgaaatttcagtgtttttttttgttttggtgtgtgtgtgtgtgtgtgtgtgtgtgtgtgtgtgtgtgtgtgtgagatggagtctcgctctgtcacccaggctggagtgcagtggcacgatgtcagctcactgcaacttccgcctcccaatttcaagcaattctcgtgcctcagcctcccgagtagctgggattacaggtgcctgccaccacacccggctaattttttgtatttagtagagactgggtttcaccgtgttggtgaggctggtttcgaactcctgaaatcaggtgatccgcccacatcggcctcccaaagtgctgggattataggcgtgagccaccatgcctagccttcagtgatattttttaaagtagtaaagataaggcactggattaaaattcaatgataaatttttctttagtggtattatcatcattttcaccaaaaagcaccaggccagtctttcccaagagtggtaagatatgccttgtggtacaaatttaacccctttttcactgcaaatcaacttagactaaattttaactttgaacttttactaatgattagagtcatttttaaaacattgtcatgaagtttacttcttgatttatagcttataattttctggatgtgtgtgtgtgtgtctatatatataccatgctactgaattcatttgataatctttattttattccagttctactccagtcttttcttcacttcccaaatgtacctgaggtgataattacattgtaggttttgctaaaataaagttaggttttaattgacctattcttacaattaaagcttaaatttccatagatgcgattttgtctattagagacaggaatttcctcacttttcaagattcaagatattctaagtatctgatgcacagttaacaccatttggcataaatgatgaaatatgagtcacttcaaagaatgtgatctttcacttgacagggaagataaatgtcttaggagaaaaagttctcaaacacaattttttcttaaaaatatatctagattagattattccacaacttaatgacattaaccatactagtgattctggacatattcaagctagcttgaaatgtaggtttttcttcaatttctgatttgggaaagtatatggattatggctcaggattgaccaaagggaaatttgcatgttgtttaaagacttgtgattagataatctgatagtgtaaatagttgaaataatgaacataaggagagccctggtgggacaaaagaaagacagtaaaactgtgctttgctttaggcagtccctacattggcaatagcagcactacagaaagagcaaagaactgagatttatttttaacttacaattgctcatgaaaatacatgttcaagatctaaacagatgttaaaattgtataagttcattgtgtctttggaaaaccccatacccttgtatttagagacaagtgtccgaagtactcccaagatgtgtttcctgttagattgttaaataagcttaatcaaaactatgatttcataataaaactattattttgacaggcaaggtccataacttttttccctcatcagaataaattgaacctgatactgtttaaatatctctaaaggagcatttgctctgaagaaacagaacagcaggaatatttggagtacttctacatttggaacaatagaattaatatggctttggtcatctccaaaccctttatgttacagatattaacagctttgcccaagacttttctattgaagtagcatctttggtatgggagcaatttgtactatagcaaattgtatctcattaaagattctatgtatcaatagtagcaaagaacacatcttatatgtaggattattccgtatattcttagacattttaaaataaatgtttctaggaagtaaaatataagaaattaggttacaatgttattgattttaatatttgttttctcaggtggcttaacagaattaatatgctgactgcaggatatgcagaaagagagaggattaagcaggaacaaggtaaaggaatacttttttaaaataattatgttatactttttttcctgcagttatcctatacagaaattcattgctatcacttgagagaaaatacatgtcaatttttggttatttctcttctaggcacttaagtgaggtttaacaacttatatagatagggactgaacgctcaaatttttggagcagctagtgtggagttctctcctatttgttaccccctcctcccatctctttcctatgaagaaacaaaatcttaaaaatggaaaaagtctataataggtcttatgattgaaccaagtccagatccttagcagtgagcaatttttactatttagcagttttatagacatttaagtggccttttatgcaaagaaatgagatgatcttttctttcttaaattttctcatttggtaatgttcttcagctctgttactgtgtaactctgtgatcttatggaatttgccttggtattgacctcagatttatgaaacacagtgttatggtgcagaattgaaatcttaagaacaaaagctgtggtcatcgttcttaggtggcttcacatttcccaaagggtgtttgttgtacatcccttggaaacgtaaataggtttttgaaattatctgttaaaagaatccacagattgacatacttataaacacaaacctattcgtagttgtgtcttcagtgggcatagccagtttattgatgtggagattctaaaagccttctgtttccttttagacttagagtaaaatctcagccaggttttgttttttttgtttgtttgtttgtttgtttgtttttttgaagtaacgtctcactccgatgcccaggctgaagtgcggtggcgtgatcttgatcttgactcactgcagcctcgacctcccaggttcaacgatcctcccacctcagcctcctgagtagctgggaccacaggcacacaccaccacaactggctaatttttgtttttatttttgcttgttgttttttgtagagacggaattttgccatgttgcccatgctggtcccaaacccccgggctcaagcgattcaccgatctcccaaaatgctgggattacaggcatgagccatcgtgcctggccttcagccaactcttttttaaaaaacacctgaaaactaaagtttttaaagatctaaagaagacagccagatcccaaaaccagtatgtcagcaaatgtttaggcacagattagtaaattttttctgtaaagaacctaataatattttgggctttgcaggccatatagtagagactatatgttgcataggcctaaatttatggtaagagtactgaaaaaaaattagtgttccttttcagatttctttaaaaggaataaaacagttctctgcagagactatacttgcataggcctaaatttatggtaagagtactgaaaaaaattagtcttccttttcagatttctttaaaaggaataaaacagttctctaaaagtgtttatagatttttttctgatttgttaaagacaagaattagaagtgtgggcaatgtactgataggaaaatgaatctctgactcaatttgcataaatataagggagcttggttcttaggcttaacttctgtattttattacttggcattactacgaacctgagcttcatcttgattttagtgaacttcctttgtacttggtattatatagccaaattttattatggatgaaataactggtaagctatatagttgtattggacatgcaggttccaaaaagtatttagtctgtggattcgtgatgtattggtctatcatgtaagtagagaatcataggcagaagctagtagttacaatttaatgcaacaagaatcttgctaatgcaatacaaccagaatctctgaaataattttgatttccacatagaatgcatgttcctcagtcactttatcataggtcagaaacatattagacttcttacctcctgaatgattaggttgcatggtattccatgtagaaaactactagatgcacatatctacttcacccttctgtagagttatttgagtagagttatatcttctgagtaccattctaagtaatgaagataagcttaatacaaaatatagctctttgaggactgggaatgtttctccacaatggagggacatagctgccagatactgtttccatctaaatagccagtatagcttagaagtgactctttcattgacttaaataaaaatttagtgaattgctgtctttgattacagaagtataaaagatgtggggttctctttcaacatccgttgttgtacttagagaaaacagagttacacttaattcagctgccaagatagcaatttggctaattgtctactgatcatttttgtattttttccagcttcaagacagacattcatgacattattttcagtcacacataaggtctttttaaagccttaatcacacacaaaaatgaatgaaatatattgtatttcttcgacagttctaaatgaaaaagtcttttttttttcaaattatccttttgtgtcaacatgagaaaataaagtagaagttttcctcttctagtgttggcactgctttttcatgattgcttataaaattgcgtatcattgaaagagacattaaaagtatccatttaatttgtgctatatagacagctaagaaaaataaattaatttgccattagaataaaaatcagactagttttcatcctctaagcaacagtgtgtctctaattttccacacaaacccaaaagagcctaactgaaatttctatgtagcctcttctctgtcattgctctctcaaagacacacagcttagtgtaagaaaaaaaattaatttgcaaagtagtatttcagccttttcttaggcaacccaagaaaactttggattgacgatgattgaattgaacaatgagaacacttggacagtggaaggggaacatcacacaccggggcctgctgtggagtggggggagggggaagggatagcactaggagatatacctaatgtaaatgacaagttaatgggtgcagcacaccaacatggcacatgtatacatatgtaacaaacctgcacgttgtgcacatgtaccctagaacttaaagtataataaaaaatatatatataaaaaacaagaattccatcaaatagtgggactaaaattcttcctaatttaactggaaggaaaaagtagagaaggagccttccaaaatctgtcacttgtagtgacagctatggaacccttgataaaatcatgatcatctccttagtgtgctaataaggaccacttgaggtattaacgccttgaaggcatcagtgcaaacatcaaggagatactctgcacaggtgccacagttcctggaaatagtgggaagaatgctggcagggtgatctttccttggcaggggcgggtttgcttattccatttacctacagggtgatttcccagtagtatttcaagctctcacaaaactaccaaacccaggccccaggactccagattttacttttcattgctgggccttgctacaagaaaaactttatgtctaagaagaagaacaccaggcatttatttcttatgtgatctaggtcacactgtcctgtcatgctactacaaatatacccaagaagataagcagttctaatatttattgagtgctatcaagatgcaaggcacttgaatatgtttccttatttagtgcccacacacacacaactctgaaaggcggttattattagaccccttttacagataacaaaacagactcagagaggttaaataaccaccacaagagcaccaagatgggaagtggtctagctaagattcgaacctacacctgtctgactatatagttaatgtgtttttccatcagcatttgctgggtccgtttctgggcaactgtgccaattcatatttgagggaaaacttggtatactggctgtcactggcatgaaccaatggaaaaaaaacagatatcaaattaagattaactagtctttgcttatcttttactcaaaaggaataattaaagcagcaatagaattttcagagtcttcgtattttgaggcctgaatatagttgagaatgtattttatttccaacttccattgctgaagaatttatgttcacaatagccggaggtacatagcaggaggagatagggggataaaatgttcatcaatatacacatcaaactctcctgctatactttacaaaagagtcccagcaacttagtctccagagctttagggtaaggcagtttcttagttcaaatcccagatctattactttctatttgatatgtagtaatttcttaatgtatgttagctgtaattatcattaatattaatcagcactgcagggaaaccatatacaaatattacaatatgggaattcgtgggtggagaggggttcctgtaaatatacgtgccatgattgttcacctaaatgtgaatattagttaagccttatgatagttcttttgtgatttaaattttcataagaataaggagacttttgttttaatatgttttttcttatcatctgaaattgatggataatacttcaggttttttcttgtaaatcatataaagaataaaaccagcagttacagggtggttggaatattactggaacagattccgattattagcccttttgctgcatttgacttactctagtaatttgaacttctctctcagagttctttcccctccctcttgcctgaggtctgccaagtcactttgtctagctgcttacatttgctacccttttaagtagttctggaagtttggaacttgcagcccacatcagcagatttgcccttttgcatttggcaagaatcagaatttgccatgtgtttccaaggagaggtgggagtatggtgttatagagattcatgtcagcatgagtctggaaacagtgattgttagataatcagtgaactgaagccagagaagagaattgagagcattatttttagagttgtttatatctgtagagatctacagcaatgtatgtattgcttttctttgaatatctttaggataaaatgatatacctttaagaggcatcatgtgatgtcattcattaactgaagcttcagaataattgggtctgaaatctgaggtaccctaaacctgactgagctcatgcagtacgttctttttaactctctaaaattatggctgcatgtaactgcttgctttaaaaggatgttagaattaggtgattgtacacttactttctcctcaaaactcaactgaaaataaaagttggtaggccaagggtaaggtagtgctggggaacatgatgttggaacagaatttaaatttcctttttttaaatgatagtttatgttcgtgaaaatatgaccagaaacatttagtagaatgttgacgtatccatgtctgtgaattttcagattactggagtgagagtgacaaggaagaagcagatactccatcaacaccaaaacaagatagccctccacccccatatgatacatacccacgacctccctcggtaagttagcaacaagaacattacttatcaccagattcttctacctgaaacatccttttgtatgttaaaaacatatgtagtagattgcatatcaaatttaaggtttctcagcggaaaagaaaactgggagtctaaaatcaataagcaaatttttttaagtatacaaagaatatttaagcaggaaaaacagtcattacagattccaggcagaataaatatgtcatcacttttattaacaaaatatactgtttgtatgaaggtagccttcgtggagataatcaacaacaacaaaaaagttttcttagaaaaaggtatataaaatgaccttatctattccacactaataaagtgtattcctatgtcctttagaatgaactcataaaaattaatattatatctatattgaagatatttttgcatgtagctttttcagcagccatgggacctggtttaatgtatatgtttgtatggtgtgtcagacaaatctctgtaaattactctgtgtatagactgtactttgatcttttaatagggtaaacagctggtttacttgggactgtcccactttatggccctttcccatcagaattaccaagagtgtctcagtaatgttccagtttagacaataatattccatggtcaggccgggcatggtagctcacgcgtctaatcccagcactttgggaggccaaggcgggcggatcacttgaggtcaggagttcgaaagcagcctggccaacatggtgaaaccccatctctactaaaaatacaaaaattagccaggcatggtggtgggcacctgtaatcccagctactcgggaggctgaggcacaagaatcgcttgaacttgggaggtggaggttgcagtgatccaagatcacaccactgcactccagcctgggcgacagagtgagactgtgtctcaaaataataataataataataatattccatggtcacattgccataagaaacaattctgcctatcttgggactaagtcttccacataggaaatagaagctggatttaggtgacaacaatagctaacctaattccatctcagtattactccagggggataattcatattttctctctttttctaaaacgtcaggatctggacaatttctttaaaatatctataaaagaggaagaataggaaacagcatcttcactgaacagctacttaaacatggcaatttgtgaatttcaagaagaaaactattcatattattattaacatgtgggaaggtaactgactgcccgcagaggatgccaagtaacttctcctcctttaccaggaggagtggtatgcagcttcacctcagtccggtgtgtcctggctgccacctcagccctgtttgtgatgatcacatttaacaaatcaggctcgacctgggccggtgtgtttgttagtccccagagctagagtaaggcttgtggcagtagaggtgcctgcaactatttcacagtgttcacttgatgccagtcctttttctggttatgttttgtgctataacatatagtcccaagctttaaattccagggataaaaattttccatttttcttttatatttatgtgccctgcagtatctatgctcaaggctaatggtaatccctagcaatgtatagtctcatcctgcctaacatttttaaccccatagaaagtaagaccatcagacagcttttctctggcacccataggagcagacattctcctatgaagaaaaggaagggttctttctgtttataggcagcctatcctcatatccaaaagactctctcctagtccccaagcccaagctacatgaaatcaggaatatgaatccagggacaatacttcttcaggatctgaaaatgtatagtttttaaagtgaaatttttgtagttgctgaattttcttatgtaagcactaactcttatacttgcattgttgtaaaattttgcattaatatgtcagatttttcatgagaccttggtatagccgcattccaatacatccatgtctctgtctcttaaaatgtaagctggggcctaactttgagatgtctgcaaacttgcctagtcattaacatgactacgtaagagttcatctacttaaatattacctggtagaaaccgaatgtgttccttggaatggaagtggtctgttattttggcacagactaatcaggggctcctttctacagatgagttgcgccagtccttatgtggaagcaaaacatagccgactttcctccacggagacttctcagtctcagtcttctcatgaggagtttcgccaggaagtaactgggagcagtgcagtgtctcccattcgcaagacagccagtcagcgccgctcctggcaggatttaattgagacgccactgacaagttcaggcttacactatcttcagactctgcccctggaggattctgtcttctctgactccgcggccatctccccagagcacaggcggcagtctaccctgccaactcagaaatgccacctgcaggatcactatgggccataccccttagctgagagtgagaggatgcaagtgctaaatggaaatgggggcaagcctcgaagttttactctgcctcgagatagcgggttcaaccattgctgtctgaatgctccagttagtgcctgtgacccacaggatgacgtgcaacccccagaggtggaggaagaggaggaggaggaggaggaggaaggggaggcagcaggggaaaacataggagaaaaaagtaagtatgtttctggagattcttagcctgtgtacacaaagtcctgaccttttcaaacttcttatttgaagaaaatagaaccttgcttcccttttttcttaaaataatagtattgctatatagtaagttaggtctcccttggtgacctactttcagaacttcagtaacttgggaaaacatgatgagtaatgaagcttataatctcaagatacccacagctggagcaaataatttttttctccaactagccatttgccttttaaggttaatggtgtttttgttttcttccttctcttatccactttattctcacttgcatgcaccatctcactggcccacagtggttgccccctgagttgggttaagaaactataaatgtttcaagcaggttgttagcagagccttggttgaataactgagtatacacacacacccactcacatctatacatatacatatttatcttccctttttattgtcagaagatttaaaggaaaaatccaaaagatagtttttccaaggagagatttcacatagcatttctttcaactccaaatagctgaatttgtttctagaaaccaattttccaaaagcatccatctaatttcttggtatgtgtgttgatcgtaaagctcaatttatgtgaatcaactcttataagaaaagtcaatgaagtaatcctctgccttgttgacattaagaatatctttactagttattaagttctttattcaacatgccataccaagcctctgtttattactaacatgacacatcagtccagaaacccaggctggtttaagggaaaggctgtaactcagttattttagtaagaaagaaaatctaggtttggctacaagtcctgaacataaaatgcacaaaacaaaatatatagaagaaatagtataaaactgttcacatctctttattcaaaatgcagtctgggccaattagcgcagataacttgagcaaatggtgatgaaatcacagttacttgtttggtacccctagggcaatagacttctctttttaaaaagatgaaagcagagtgtagccttcagcccattttacaaatatatgggactttgattacagaatatattagtgtaagttcttcatcacaaatggaaaaatatctcaaagttcacagattaccaacaggtcaagagccccatgtcagtgtcaagcttggctcatttaaaatggtagtctctttggaaatgactgacaagaaaatacagtggacctccctttatggtgtggatcttcattgcattatttaatattatctcatctaccaacaaaatataagaattgcttgtaataaaattcatatgctgtggcagtttccatgtgaagtatattttagccataatctccatgagaaacattataaaaggtacgttgttagtacaggaaaagtaattaccattcattacttgccaagccctttcaacattcacatctatcagagtttatggaagaaatatttaggagccatgttagtcctctgcaggaattctggcaagcataataataatgtttaatattctaaagattactaaaattaataaattgtcttctaaaatttaaagatgagttagaaacttcatttcaactgtcattcaggtactacacaactgctgtgactaagtatgtgaggtttattcttttacaaacattggagaaaacactttatctcagccattttaagataaactgtgttgaaattaggcacagccctctgaaatagagaattctgttcagaaaacatttcatcattcctacaggttaagtcactaatgttgtcttgttttgaataagctaggcacttaacagttcatcctggtcattgaataagggaagagtagaaagaagcaagcgtgtcctaagacatgaagggaaaatatggcaccatgcttgctcattcttcaggtttccagtagtccacagagcacttctagttagatagctttcaatttttttcttctagattatcttttttgttgtttagtggattggattttttagccaaatagatgcactcctaagttggttgggttttttctttacatttcagatgagtttagtgggtagttattcagtgctttccatctttttcagtgggctctctgtagaataattgttataagatagaacagacctagtaagtgtgtcagtaaatttggtattgtactttttgtctttatggttcaatattgtgggatgtttcgtgctatttcagtcagatctgcttcactgaaagtggccttgcactgtctttcaggccccatttctttctgggtattttttccataaatcttgccacttgatttctccgtgtacttcaaactgttcgtaacagagtagtgcattcatcctttcctggaagatgcttattattcaatgaaatgtatgtttgttctaatgatggttttctgcattgctatttctaatatttaggagtgggcaatttgatgaacaccttattcaggaaacatcagctttaaaaaccagtgttttcaaaagaatctttaaggtctagttatgggatgtcatgttcatggcttccctggattgaccattaggagtaagtactcaggctgcttgttcaaatcaagctgtctggtgttatgtcagcagagcaaaaattatacacggaaacgaagctgtggccattacatcagccttaacgtcctgtacatgtcctccaacacagagcgcttactgtgctgccacacagttcagcaggcaacctgtgcttttaaaaatcaaagtccaacagcagtgtgttacttactgtcctgctccaggccagcattcagtttgacctcctgaagtgaattgtagtcatcaagtacagaactgcagaggaaataagtttaatgtctagttccaaacgtttttctcagtttgccaagaaattaaaaataggaagtatcaggtggccaaaagaaataatggaagaaaacatgaaaatatagtctgtcatatgctttaagggtgaagaattatgtcatcaaccaaacctctttcttatcatttacgttttatcttaccttatatcacaatatatgttatatagtgcttatgagcttacagagcaatctaagaagcaagatatacctaaatccatgccttagctgtttttcattttccttatgggtatggaatttggccctgcttataaagtatatatttagccttccttagaacagacttcaatctgtgttctcgtagttgaactaccttttgccttattttgaaattcaattatttaactgagtcatactgtgattttcttaggctgaactcattttagtctgaaatggatggtactaaaagtacacaaatgagacctgtcttgttttcctttgactgaaaagtcagcttgcatattaattgtcttgacctgcttcactgacatttgagaaaagacaagtaatttcctgttatcccaattagcagtttcaaaccttacctggtatggacattataagacatcagctaaattaacttacaaattatgtcattctatgcacctttaaaggaatataaattatgaaagtatgggacaaaatatgaagatatatttcattcagaaataatctgccataacattaaaatactattttggttaatacagcttgaagtcagcttagaaaatctcgctttcctttgccgtatgtactagccaattcagatgaggttttgaaaaccattatcccttaatcctgctgattttcccctaagcaattataagggaactctcctggactcttgatgccttcatttactcggtgaagtcatgatgtcctttatcattgtcttgaagattacctaccagtattctcacttaatttacacgtatatgtagcttgggcttagaaatctaaagcaaaacctaggtcttttaagggggaataaaatctattaccttggagccactgtacacattagattatcaggctgaaatattattgacactttcaaaatgagatctgctgagaaatatattttaaggttatttttaaaaatctagactgagttttgtggctcacgcctgtaatcccagcactttgggaggccaaggcggaggatcacttgaggtcaggaatttgaaaccagcctggccaacatggcaaaaccctgtctctacgaaaaatacaaaaattagccaggcgtggtggcacatacctgtaatcccagctactaggtggctgagacgggagaattgcttgaacccgggaggtggaggttgcagtgagccaagatcatgccactgcactccagcctggatgacagagcaagactctgtctccaaaaaaaaaaaaaagaaagaaagaaaaaaaattagccggtcttataacctgctctataaataaacaaaataaataaataaataagtaaaaaatctaacattctttgtacactattaataacttaggagctgtgtagaatatgccactcagtagcctaaaatcttaaattattagggcataggggctagattatgagtacaaatacagagcagaagatacattaattcttgtcaatcattttaagggtcctatcttcatttcctgaagattttctaaaggtcatgaattctatttttaagaacattaaagtaggagatatgtagacaaggagaaggtattcccagaatatgaaattgtattgaaggaagaaaaggaacaagttgaaaataaaaatgttgcaacacttctcacttttttattatcaagataaattatatacacacacaaataattttaaagagcataatcatcattaatatcttaagttatagttcatgtctaaagggagtagatggagaaggatatacacagtgtgaagaaaaagacatgataaagtcaaagaaaaaatggcagagaaccttaactatatcacttttgtaaagttgagcacaccatccttggctgattatataacaaatatgtatttaaaaaaaacagaaaaacctagaaagtagtgagaaaattattttaatatattgtctgattttgaagaaatactgttagggagacataaaacactgaagattagctataattctgatactggttataggttagatttttaattacacctccattttttggctaaaaaaatgagagaaagttattaacttacaggaagttcagaggtggggttgttctggggtgaatttcatggcttaccaatgtcaggactctccattcatttttctgtaatgcaagagctccaagcatcatttctcatgagacagcattcaaaaagccaaagaccaggccctatctttagtcctttctataagaccaagggaaactttccatggatccttccagcagacttatacccagatttcattgccaaggttgcatcacatgtgcatgcctaaacaaatgacaagggaaatggaatgatatgaacagtttagactaaccttgatttgtttttatggtgatgagaaagagaaatgtgcaaaactgcttatcattactttctgcatgagcagctctattactgtgtatgttttgtcttcaaattatatttgttcaagcagtgtttcactttttaaatatatatatgcacatgcatagcccagatcacatcaccttacttaaaaattttggctctattgaaatgttagatatataaatgaagtaataagtattatgtaaccctgaaaatgtagcaagtttgatataattattgttgctcatggaatgaataagcatgttttcctatagacaataagtaatcctagcttagaatacagtctctggagatattcctcagttcaaatccttgctttgtcactgtcccacttacaactggtatgattgatcaagttatttaacacctctagacctcaatgtcttcattgtcaaatcatatggtaataatacctagcttttgaggttgtgtgagtattcaatgaagtgatgtcagaaagcaccttagatccatatgtgacacattataagtctgtccagtaaatgttatatagattttatataattatataggttttatatttgtttcatttatagattgatataattatatagattttatgtagatttgtattaaggcaaagcgggcaattacaatacttaaatagtgaattaggcctggcaaacctcattaagtaatgtttactacatgtcctatctttgttcagttctagccattgagttgaaccatacgaaatgttgcttttgtaggtcaaaatgatgaaacattagcaattttgtgtgtttcaacctaacatattagctgcgttctaggagtaaaatagaaatgttcctcatttcacattcctatcactcactactcctttcctttttgactttggacatttgggaactcaaaagaaaccttgcattccaaatagcaataattgtatcagatatatttactgaaatgtttatttatagatcttgtcatttgggtctcatttcaaatattttcccctcagagatcctttcctgacaacccagtctgacccagatgcccaccaccaccattcatcctcttgtatggttaccctgttttatatttttcccagctttatcactaggagtataatattaaatattgttcacagatttattttccatccctactaccagaatttaagcttcttaagagcagggattttattcctgtcttatagcacctaaaacagtatatggcccatagtagcccaggcactattgaaagaatgaatgagtgaatgaatgagtaatagctaaccccttttgttactaacttcctttcaattttattatttatagagctaaagttattttatccaacatatgacataaaacaaatcaaaacatcgcagaattcctcatttttggtattttgtcaaggaaaagccaggactacatgtgttcagcataccctctttatgctggagaccacaaagctgggatgctgataactagaattactgctcctcacattatggctgttttatggtcacattctctatgattgaaaccatttcctcctgtttcactgccatttcaaaaatgaaggccacaaaaatatgacatctgaaataactagttcattgtcataaatcagttagaaaccagatcttccagctctcttaggcagttgttcttcccaccaaaatccactgcctgtagaaggaaggaaaactcaaatcactgccagtgcttggttaacactcctagtcgtccattacctagcttcatcttaattagtttgtaaaaagtgttgaaactgcaacttgtactttggcaaataaccagtagccctgcatcagccaggaaaataatctcaaaagtgttagtaagtaatgacatcagatgtaaatggcaaaagaaggaattctaaatgctgtcaagtcacaacagcagaagatgtggccagaagagagctaatgctcacacaaaacaatgtcaacccctcactagcataggtaaggcaagttatgatttatgttatgttatttttttttactgagagagattattagattcagccacactgttatctgctattattttcacacatcaaaaaaaagcaaatcacttctcttcagctcaataatagcatattattcatttctccatggagtaccttctagcttattgtataaaaacctatcattctctttttaccttgctcacccttgccagagaaggccgaaggtcacaaatgcctcatttttgtccctcagcataaacaatttacctcctatggttggttaccaactaccagaagatggtagattatgatttaatatgattgcaccataaaaatatcttggagattttttaattaccctatttttgttgtgtaattcaaaagtaataacttgcttattgcaaaataaataaaaagtacagtgatgaaagtgcaaagccaccttctcttttctttactctccaaagttaactactgtcgaaagttaaggttttaaaaatcaattctggcatgaatttattttccttatatatctctatcttgtaactcagtgtgagttagggatatgaaggatggtttagttgattatcagttagagttcctctaaaacttttttgatatggcgttagtttataatgtaagcaacagtcctgtgaaataacttacgtagcaccttagaatccagcccaatcccaaaatttattactctagaaaatgtagcagttgaccttttcaaaaacaataggagaaatatgagaagaaagaaatggcattggctgtatatgcacactcactcatacactgccccccccacaaacacacccccccacacacacaccccgactcatacatcagaagttctcttgcctacttgcctaatgccttgatgccttatggattttgctgagctttctttatgaagatcttccagtactttcagtttataccaaagctctgtgatgaaagagccaagccagagccaattagaaaaaaaattagcaagtccagccttcaaaaggcagaaagcagaacttggatatgggcttcatagccactgagtctggtgaccagtttacctacggattttagcttcaagttataaaacactgaactttctactaaacaatctctcctatttccagtgttctcactagtttcatactactagccactcagactttcttatgccgtgccgtaggtacatcttggcctaatatttggtcttaataacataatctattacactctaaaatttgtcctttaatgggaaaatattcccactactatgtcattcaataaggaaaaagtgcccattattatatttttaagtggaaaatttgatcttaaaaaattaatagttaaacctcatacttgaaaacttagagcagcttcttgtctcaagaatgacaattttgtatatttttgtttttattacaaacacaaaatatgccaataaaatcaactttctgggttatttcacagacatttttggaatacttgaaaataagagttatagttgtgtaaatcactgattgacttcagagcttttagagccacaaactctttaacattcttactcttagattttctgacatttcaatatctagatttagccagctaaaatgcaaactaagtctctgtatcgtacatatggtttgctgtatcaatatataattcagttaattccaaacatgcattcatgcattcaacatgcatttgtttatttttctacacacagggtaccatgttaagagcctgtctagctcttccataagtctacttacaacagaaatgtgtaaattatttttaataaatgagattttttctttctgataacatgaaacacagagagtaattccaaatatgcaacatctttgttaccttataccagtaattttccctagtaaccagtttataattttataaaaattattcattgagagatggtgcaagatattttatttttatgttaattacttatcacttatgcaaaatttataagactagttaaaatcagatgagatcacttaaagagctatttctgattcagcttattccttaaacatcatggttgaggaatatgcattctggttacccagttgtactgattaacacaaatcagatgtctaaaaatcaatgaactgaacttcatattatactgaccatagattaatgtttctttttataattgagaaggcacttcttaatgttacactataatcattgtagaattttattattggaaaagcctattaatatagggaatattagcagagcattaaatacagaaaattgtattttgaatgtctattttagggaaatttgaaccttaaaattttaaatagtttttcatttccttccacatttgaaatccctaatcttccatgattttgaatctgttacttttactgcactatttctcttttgataaatcatccgtagaatgtatttacttaatgcctaagatctattcacttaagacctccgaattttctcatctatgactttattggctattttcgttataatttttttttaatttttgttgttgtggcccctccactgctccatgactgaatttagtttattctgtaacttacgaaatggacactgtaaagcatacaccttgagattcttggtgagagaaaatagcccataactttgatgtcactaaacttaaactgtacacatttttttcctatcatctctaatgttttctcctgttctttagcaatgccaacacacatgggttcacatgccttttcttaaaaaaagaaaagaaaagaaaacacacggggaggagggacagctggaatcagtgtggctttaatataatacataagcaaaatctgacaataagccccacccctcactttgaattctgttatctttttaaaatcctatgtagttgctgggctgccttctctttatttagcatcttgggttcttagattcatgatgtgcttttattgacttaattaaaaggattttgcctcagcactagaggtaggcaagatgtttatcattacaaaagtaattccgtagaaatactgaatagctttgctgaataagtaactgaaaaggtgccttaactgaatgcttctttaaatttttaagcatctttttttaatgtgtcagtggtatctctctggcaaatggtaaatcactgatttactattaaagatgcttaaatttgtaagcatctttttttaatgtgtcagtggtatctctctggcaaatagtacagtacctattttaaaatgttttatgttaagaaaaagggttcatttaagagatgaattgtttttaactgggcttggcatggaaaatgagtcatgctgtatgtaaatatgcatatagccctctcaccatagaacttagagttttgaggcacttatcttcactttctacccaaaagagaaacttttgcatattttaaaaattgttattgagcctctgcttgaatattttaaagactcggaactcccgcctccaaaagcaggcatttcatgttgaagagccttacttacagagttcttccttgtattgatacaaaaacaaatttctgccaaactttctactcattgtggatcttaaaattgcaaattagaaaaatgcagagcaagcatttgaaagcctatcatgtggaaagatggacaagatagtctttgaagttccagagaacatagtagataaagggcacaaggaggctgattttagattgatatggaaaaaaaatccagtttttgcaggtttataacttacgagtttagtgggctcctcattactcgaagtgtttaggaagaggctgaataaccagctaccagccaggaattcccaagttagctggaaagttcaacctgatggtttcttccaattctaaagttttatagttctcttcagcataatggtcttgccctttgctctcaccatatgccttgcacattgtatatatctccaaaactctaaaatggaattgtgttatcaaacataatttgtgttgtctcttcttgaggtgtctttatgcctgtgacacatgagttctagataactcatcatcctggctaccctcatctggactccttgtttctttatagagtccccatgctaagtgtattggaactattacagtgatctagacactatacttttgttaacatgattacattagttttaacctgctcactgttggctcatataatgctttaatgttatcaagtgataagcattccacttactttattttttaatctaagtgcagctatttatatttatttctgttaaatttttaatgtctcatgtttcacccaaagtatttgactctgttacaaagtttagaatctcagttttatcatgtatgatattactcatttctcttatcatttaataatcctccaaaattctaagcaccctttctgtgtttttaactgattcatcaaggaaagtacattttttaagaaaacattttaaggaagaaaagaccaaggacagagatttacagcattaaattttaaactttttgtgttaattttattcagtcattcaaagtctttatatagatccacctaatagtaatgtcattcagcccatattacagtatctttattcatagggtatcaggtaaaatttcatcttatgtaagacacactgcccagggttttcctcttcccttccaacttagagatactgtccccaaaagaagtcattttaaaatgcttcatttttttattaaattcatattggtttgtcaaacgaaattaaaaaacaaaacgccacccactcatcatctatttttacaaatttatatttatatcaggtttatcaatatgttcattggagaactcatgctttgtttgtttggataagagggctcttaagatttaagcattaagtcttatggaatgctgacagtagccctaagataatttccaaaaagtttattcacttgctaagattataaccttctagtttaaaggaaccacagagtggttcttagtagtcccttgtctccagaagcatttatgttttaatgccctagtttgaagactttttctcttgcaggaaaagcctaaattgtcattgaaggcattatagttctactttttatcattgatattttcttaatttttctttacaaaagctttgtatcttcagttttttcataagcttcagctgaacatttgcctttgtggagctcttcttacaaacaattggtattattttctacttgttcatttctcgtagcctcttattctatattttatagaaatcctccttaaactaaggcttgttctaaagaagttccttgtaactaccttgacttcatctgcatctcctttccctccctcattgggacagtttacgtttgtattactggaatttaattttttaaaagtactgatcattaaaactttccatttgtctttgtaaagttttaaaatcatatctttaataatctaaggtccatatccagctatgtgttctttctcctcaccactagaagaaaaaacaaaagcaaaattacataatgtgtttcttttagttctctttgtgccataaaagttcttccctgttgttcagcattagatcccaaatagattccaaatatttctttgtatttctgaaacatgaaaccatcagggtttaaatgcatgcagtaattacttacatgtattgatctcattttcaatgcattaaatcctataattagtatattgatggcttgaccagaaaatattgaagttcaggttatattattttatattttttcatcttcagaagattttatagaaattgattcaacttttagcctacaaataataggaaacatgacactataaaaattaggtgacttcattaggacaatttacaatatttttaagcctgtgttcttgcatgcctcagtcaataccagaatatgtttgtatagagtattggaaccctacagacctggttggacttttacagatctagtaagagtaagaaaataagagtaccatagatttctaatagtttgtttttgttagatccaagtcctaaccctgatcagccatattctttagtcaactgtattcagtggctcctaagaattatcatttctatactatgccccagtttacattctttataaataatagcttcaaattacagaaacaagttgcattcagacttcttcattttaagcccttttacctaaagtaataatgacttggtagtataaaactgtactaccaatttctgctctaaagagcttatagaaattggggtgatatttgagtatttgtttattagattatcttgctgtaatctatctagtgcaagatacttgctgcctgtctgtaaaagaaaagtatgtttgttgaaggtaatctcttccattatatttttagaaaatacatagtaacatttcaggatgtatggtttaatgaagagtggtgttgcaccacattgttgatgctccttgatattttcacacatagccagtgatatacctctcccaactgaataattaacatagctgattgtaaaaataaacaaacttgatttagcccttcaaaatttatttgcctgtaattcactgagcttatacgtattaaacaaaacatataataggtacttcattgtcatggaacccaaactaaataagtattaaataaaactcattcacggatttataccttacaaaatactgcatattgtcagaagaagaaaggcataggtgtccaaaaattggtttctaattaattataatatggataatttttttaaaaattgaataacttttttacaattccagccaaaatttagcatgtcctccattatatggagcagtgaatttaaaaattactttcatggttttagagtttgagacagccaaattacacaaatgattcactgtttaaacatcaataatatttccactggtggcataaaatcaagcttcaatttctaaaatgtgtatggaaatcctatgcattactgatatttagaactacctttttggtatattgagatgattgatattaatcaggagccctaaatcagttgataaactattttcacaaaatgcagagatattctattttactttgtgccttaaattttaaagaaagaaagaaaacaaaggaaaaagacataatttagtttgttttacttgacagtcagcaaaagtccactaagcagggtgtggctatcatcccaaaggtgaataataacagcaatcataaactggactgatcatatatctgaacaatgcctaaaatctcaagaaccatttattgtacttgcaattgagtgtagtgtttaaaatgatgagaattttgcctacaaaatcataattcctgtggataaagaatgggcacaaactgctatttttctctaatataaaaagaaataggctacctctaagtttgtttttttgtttttttgtttttttttgagacggagtctcactctgttgcccaggttggagtgcggtggcgcgatcacagctcactgcaaccttcacctcccgggttcaagcaatttccggctaatttctgtgtttttggtagagatggggtttcaccatgttggccaagctggtttcgaactcctgacctcaagtgatcctcccaaagtgttaggattacaggcatgagccactgcatctgcccacccctaagttttctatcatgattgttccaaaaggtagaattatgatgtattaatttatctgcctaaccaaacttttattctattcattgcacagtttctaaaatcagagattatcttaaattgacaatatctgacatatttctatattatcccccaatagctcataattcaggtggttgtaacccaattaaatgatagaagccatgaggcttgactgagtaaggtagaatactaattcttattttttcattgtctctaatgaaatgactgactttttagaaaagccatttaatttacccactaatattataaggcatcagatatttttagagaatgcttttttagaatttaaactgactcagttttcaaaaaaagattattaaaataaatgcacatcgtattctaaaagtaaaaataaaataattcaactatttgggtaaaatttggtgactctttttctgttaaattttcaatatttgatggaaatgaacatataatacatgtaacatggcattttaaaatgttaaaacagtaactaatggttatgtcacaatcatatttattttgcctgatccatgtggtacagaaacctagccattcaaaatctgtttaaaggacaaagttttacacatagcaataaagctgtatcaagcaatttggctgcaaccccttccaacatttccccaaagtagcagggtggtgaggttttttatagtagttccatcaatctgcttctatcaacagagaaggacctttagagagtatatttttaagttatatttataattaaaatctcatcctgagtctaagattttgtcttacctcatctactcctaacattaatgacatatgaatatcttgacaatgtaggtcattcaaagaaaacaccctttagcagtggttacactatcatttcatataaggccaaaatcatttttccttgacatagcaagcagtgctagaaatagcattctttgacctcagtgacttatcttcctaagatttccccctctgctacatagttcaccccaaaaactttaagtagatcttctcacttcaattgaaaacctagtgaggtataaagcattttacatagttgtttaatagaagtctattcagtgttcagcttgtacccgcaaatactgagattttgaattaagatgtatttgggcaatttaattaattcaaataatatttatggaggcaacacagtgtcctgagtacccactctgctaagtgctggaagaaacaaagattttaaaattacagaatcaataaattcatcatttaatgggagagaaaaacatacaaatgtaactgtacagtatattagatgttttgagaaatgaacacattaagttctatgaaagcacttaagaggtcttgattatctctaccttgtgaaatcagacaagacctcacagaggatgtgacattcaagctggatgaataaggtttcaccaggagaaaaagaaaaggagggtacattctaggtggtaaaaaaaaaaaaaaaaaaaaaaatggcatcagcaaaggtagacaggaagaaaaacaaagaataatttagagaaatatggtatttagtgtagatgagtacagatgagacaaagatttatgttagaaatgaattaaaaaggtcctaacataccatgtttagaagtttggattgtatcacaaagaacatgatagagagcttcggtaggtcactctggccaatatagatgtattaatgtgggagaatacaggtgatagggataccaattagaaaactaattcaacaatccagatgagagatatgataccctcccttgacaaatgtggaggcaaaatgttaccttctcagaggaagatctaacagatagaaagtaggtcttgaagagtaaaatggaaacttggagctctcctaatgaagaattggatattgggctaaccaggcactaataagaggtctgccaagtagccctgaatggcctgaagtcagaaaacacaaatttagaatggtgacaatcagtgtgcatatacagttttttctagcaatgcccagtggccaggcaggagtaagaaagcacatattggaacaagtacatgtaatacatatccaagagggaattgaggggtctagtcagaggggtccaaattggataaggaaatgaattcaggagggagctggttcttaataagatcaaagactagacattatatcatgaaagagatggaaagagaggaaactatattcagggaaagctgtaatatttaggaagtgacatggcttaccatgatgacaagctcaaatgtgtgttgattttggattagacagcaagaattcaacacagagggcacttattacaaagcaactcttcaatatgactcttttacgtttgcatcttgaagaaaaaactttggaacattttgcacgtgagcgtgtattagtctgctttcacactgctgataaagacatacataaggccgggcgcggtggctcacacctgtaatcccagcactttaggaggccaaggcaggtggataatgaggtcaggagatcgagaccatcctggctaacatggtgaaaccctgtctctactaaaaatacaaaaaaaaaaaaattagcctggcatggtggcaggtgcctgtagtcccagctattcaggaggctgaggcaggagaatggtgtgaacccgggaggcggagctggcagtgagccgagatcgtgccactgcactccagcctgggcgactgagcaagactccatctcaaaaaaaaagacatacctgagactgggaagaaaaagaggtttaatggacttacagtgccacatggctggggaggcctcacagtcatggcagaaggcgaggaggagcaagtcatgtcttacatggatggcctcaggcaaagagagagagcttgtggagggaaactcccatttttaaaacagtcagatgttgtgagacttattcactatcataagaccagcacaggaaagacccacccccatgattcagttatctcctgttgggtccctcccacaacccatgggaataatgggagctacaagatgagatttgggtggggacacaaaacatattattccacccctggcccctcccaaatcccatgtcctcacatttcaaaaccaatcctgccttcccaacagtcccccaaagtcttatctcatttcagcattaactcaaaagtccacagtccaaagtctcatccgagacaaggcaagtcccttccatctatgagcctgtaaaatcaaaagcaagttagttacctcctagatacactggggggtacaggcattggataaatgcagccattccaaatgggagaaattggccaaaacaaaggagctacaggccccatgcaagtccaaaatccagcagggcagtaaaatcttaaagctccaaaatgatctcctttgactccatgtctcacatacaggtcacactgatacaagaggtgggtttccatggtcttgggcagctctgctcctgtggctttgcagggtacaacctctctcggctgctttcacaggctggcattgagtgtctgcagcttttccaggctcactgtgcaagctgtcagtggatctaccattctggggtctggaggatggtggccctcatctcacagctccactaggtggctccccagtagggactctgtgtgggggctctgaccccacatttcccttctgcaccgccctagcagaggttctccatgagaaccccgtccctgcagcaaacttctgcctgcatccaggcgtttccatacatctgaaatctaggcagaggttcccacacctcaattcttgacttctgtgcacccacaggctgaacaccacaggaagctgccaaggcttggggcttccaccctctgaagccatgcaccaagctgtaccttggccccttttagttatggctggagtggctgggacacagggcgccacacctgtagactgcacaacagcagagagaccctgggcccagcccacgaaaccactttttcctcctaaatctctgggcctgtgatggaagggactgctgcaaaggtctctgacataccctggagatattttccccattgtcttggtgattaacattcagttccttgttacttatgcaaatttctgcagccagcttgaatttctcctcagaaaatgggattttcttttctatcacttatcaggctgcaaattttccaaacttttatgctctgtttcccttttaaaactgaatgcctttaacagcacccaagtgacttcttgaatgctttgctgcttagaaattcttccaccagataccctaaatcatctctcaagttcaaagttccacaattctctagggcaggggcaaaatgcccaccagtctctttgctaaaacataataagagtcacctttgctccagttccccacaagttcctcatctccgtctgagaccacctcagcctggatttcattgtccatatcattattagcattttggtcaaagccattcaacaagtctctagggagtgtcaaacttccccacattttcctgtcttctgagccctccagactgtttcagcctctccctgttaaccagttccaaagtcacttacacattttcaggtatcttttcagccgtgccccactctgttggtaccagtttactgtattagttcattttcacactgctgataaagacatacccaagactgggcaatttacaaaagaaaaagctttaattggacttacagttccacatagctggggaagcttcacaatcatggtggaaggcaaggaggagcaagtcacatcttacttggatggggtcaggcaaagagagagagcttgtgcagggaaactcccatttttaaaactatcagatctcatgagtcttacaagaacagcatgggaaagacccacccccatgattcaattatctcccacggggtccctcccacaactcgtgggaattatgggtgctacaagatgagatttggatgggccaaaccatatcaatgtgtaaagtaagttatctaatggcaagagggaaacacccattgatagggaaaataaatcccatttatattaacagtatttatgtattacatttcagttgtttagtgaagtatattcaatgaccatataatgaattatgaagaagtgaaaactgaagctattttaacttgctatttccattctaaagcaaatctcaactcatttcagtcaggtttacatcattaactgatcagtctttgaataaaataattttaaatttgatatcaagggcattctgaatagaatgactgaattatatttatttgtccttttactttcactgctgtctcaggaagactcttcttatgttttctatagatgatacctctctgttaaagtcaaagacattttagtgatttatcttttttataaagatatgccacatagtctggatttgaaatgcagtctgcaaagccaggcatgcccataaatctgaatcttttattcttttctcatatagaaaaagaagatatttttacacatggataaaaatactaaagtagaattgcctttctcaaggtaaagccaaaacacctatagtgtgatgcagtttgtttaaattttataggtttgttgaacacattaatctattacaaataatagctaacatttctaatgagtacttactatgtgtcaggcactattctaaggtctttacgtaatataagtcatttaatccttacaacaaccctgtaagggaaatactattattatccttatcttctaagtgaggaaactgagtttaaatagcataatccaggactcccagctatttaataacagacctaagattcagacagacattgtgacagcagagtgaacactcttaattgcatattgcccctcagacttataattttaatacaggttaaaatttagcaaaatatttttcactatatatgtatataatacacacacacacatacatatatatatatattgacctacataaaaggaattaaaatttttaggttttattacagcagcaccattaatatggttaatcaagtaaagcaaaaatgttgttctgatctttcaatcacatttacaaaaatttaccttttattagtagaaattataattagtgtactttccaattttaaccagtgtccaaaaatcatgtactgtgatgtgtataaacagtgaaacgagtccaccacttgagtcaaaaccctttcttagtattttaagctttgacatgattccttttatagctaatttttaatattgggatttttttttaaaaaaaaagaaaaactggctgggcccagtggctcatacccagcacttcaggaggccaaggcaggaggattgcttgagcccaggagttcgagaccagcctgggcaacatggcaaagccccaagtctacaaatacaaaaattagccaggcatgatggtgtgcacctgtagtgccagctactcaggaggctgaggtaggaggatcacttgaggatgggaggttgagcctcctgtgagctgtgatcacaccactgcactccagcctgggcaacagaacaaaaccctgtctctaaataaataaataaataaataaaataattcccaagaattaagtctggatactggtttgaaaattatttcatatggtgactaatcagaagttatttcaatttttccttcgaagttctactttatacattttgtggaaacaatccaaatatttctgcctatttatttatctatcatttggtggagatataaagcagtagatttatgagtaaaattcagagataccactgattttaccaattcctactcacagatgccaagtctgatatattgtgtgtttctgtgtattctctcatgatgaaacattacttttaatcacctcttacaaatcggaagagtaaatgcatgtaacctgaaaagaactattaaagaatgcaacattaatgctttaatctatttccaccttctaatatctcatgcagtatgtagaataaaataaaaactcataattctcacatttcctgcatcttctttcaagatattgcatataaaactacttcgtaaagtagaaagtgaaatgcaaatgttagtaccataattattattaccgagctaacatgctaaattggtttgccttcaaaatgttaacaccaaattgaagagtaaaagtttttcagtgataattcttaggattccttgaaaaaagaatactaattagaatatatgatattttgcaaaaacagcaatacctccattaaattcctagctcctctttaagaaaaccagattcagaactagtgaataacttattacttttatcccatatgttctggcttttgattttacatcttagtaataagttgatatgggtatctgtaacccacccttcttagcaggttgccatgacaacctgaggtaaagtaccagttcactggagcttcaggctttgtccacgctaaatacaaaagctgcatttgatttcagcttggccgtttctgttgggagcaatgtaccacagttctttccacttccctggctgactttttcatcaccatggagaccagatctgcccacacaactaagatgtgaaaccattcctcatatggctaaaactaaggccttggttcccaaggccttttttaaagtatattactttgttaaagaagagttcctgcttctgcttttaaagtgtttattgattttccacaaagagaaaacaaactttctggtgctgaagatttaaaataaggagaaagaaaatgacattttccttggtcagtttctggttttgtgtgtactgtattcatggtgtgtactctgcatagtcaattactaaggaataatgtttcatttcaaattatatgacaatattcctaaatagtagttcacacatttaatgttcacttgatggtgggcttaaaatgtgacttttagtttgagatttcctaaatttgtcactaaatccaatattagtatcttttagattagttctgcacttccaataaaatcagtatgagaagttattctagaaccttgatcataagtatgcatggacttaaggaagaactaatgtaatttatcactacaaatccagttatagcatatccagatagatctgatgaattagctatagaagatcatatagcccaatttttaatatattcttgcatatgtaaatttgtaatgttagtatgtgtatataggtgttcatgtgtatacacacttatataatatacacacacacacacacacacacacacacacacacatacagattagtaccacaaatagggtcaaagttccacagagttctttgaagatcacatttgttatggagatactaaatactttacagctgctattatttttttgccatcccctcccggaaaatggcatcagtcaaaggagatggtaggaagtcttaagtggtgttgggaatcccaaattcaccccttgatttgcacattcctcaaagtgacttaggatggcatctcaactttcatggttgtgttttttaccctagagaaggcaacatggcccttgcttaataaaatacatatactaaataggaattccaaaaaattctgacttcaataaaacatagaattgttcttattttttaaaatatattatgaataagctagcaccataaaggtgccgtaaattagtttacagatgggaaacaaatttattaacataaatgaattttttgttttgtttactagcaagaagttagcaatccgttgctatatttgaatacaaattatgttgtaggatacagagaactttctgacatttcaaacatttgaattttgcaagaggaactcactgcaatgaagttcctgtatcattccagttttctgtaattacgctggagagtgtgaaattcaacatgtgatactaaatgttaaacacagatatagctgggaaccttttgcaatggctataaagtcatttgtatttttccataagaacattgagagtcagcatatctctaactctttagtggaactttctgtaaaagggcagtgccatataattttgtcagaagggaaaaatgaaaattaatatacaatagggcatttttaaaaaggatattcttcatatgttgttagattcaatagctttccatcccaaatccaagatgactttgctggtccaaaatttaacaaccagcaatttccaagacagctaagattgaatatgaaaactcattacttgatttttagttaagatgaacattaatgctaatttgtttacatctatgctatatttcttacaaacatgattttgtagtgatttttaccaaattaatgtttttcttcttgtcatgtacacaacatattttgaatgcctaaaaatataataatttgaatgttggaataggcagatgacttaacaatggggatttttgaggattgtttatgatgtaattattgtagattagaaaataaaagaatgtgaaaataccatggattaaggtgagagattagatttataacaaatttgacataaagaaaaaatcttaatgataaataactgtcaagatacaattttagattcttacaaatgtttcttgaattttcttcttacctttctttggcacttgccttgctggggaaggtatctttcattgtccttaaattcaactggcagtgcccctaaagcagctccttcttgccagagttgctaatgagcaaatgatcccaaatgtcagactggtgtgccaaggaggttattaataaggcattaacatttagaagttattgatggaggaaaatcaatattaccatctttataatattgcaagctcagttagaaagagtaagcagaagtttatttcaggcttctacaatcataaagaatgttacagtatgggaggaagtaatgtctttagatttttagcataagaatcaattcttattctgctgtcagtaccccgcattagtactggagctaatgctgaatgatattcttctaataaaaatagcagtaatcctcccaaaatcaagatggcagtactttgaggatagaatatgaatttaatatgagagtaagaataggatggactagacctgtaggacaaaagttcacaaagatctatgttatatatatatacatacatatattcatttattttagtgtgtgtatatatatacactaaattcatattctatcctcagagtactgccatcttgattttgggaggattactgttatttttattagaagaatatcattcagtattagctccagtatcatgtcattcctcacgattcaattaggtaataaaagaggtactgacttgcaaaagtaagtgaaatgttaaattcttttcaggaagaatacaacagatagttctgcttgtgtgtgggggagtgctgacagcagaataagaaaagaattgattcttatgctaaaaatctaaagacattatttcctcccatactgtaacattctttatgattgtagaagcctgaaataaacttctgcttactctttctgagcttgcaatattataaagatggtaatattgattttcctccttcaataacttctaaatgttaatgccttgttagtaacctccttggcacaccagtctgaaatttgatctaaaataaatgtgtgtgtgtgtgtgtgtgtgtgtgtgtgtatatatacacatatatatgtatatgtgtatatatatatacacctatatatatgtatatgtgtatatataaatatatgtatatgtgtatatatgtatatatgtatatgtgtatatatatgtatatataaatatatgtatatgtgtatatatgtatatatgtatatataaatgtgtgtgtgtatatgtatagatcaaattttcaagacttaggaagctgtgccattggttgcttcccaaagaagctgagcagtaaaagtataatttgcatagcattaaaatttactgaccacagatcaagttagctgatcagcatcatggcagaagtatgtaagggcaaagtcctttgtttacttggagtgggttctgatgaagtgaacatactaaatgtatctccataaccccaactccccaggcacacatacccttatctattatttcaccagaatatcaatttggaaaattcaagtcgagtgtgatggacaaattaaatagcgtgggtcatagatgtataatcagtgttctgaagacatttttaccacccagtcatataagtgaaccaagattcagataaggttggaactacttttcagagtacttatcaggtaggaaagagaatgtcctaatagggtttgaaggaccaaaaagaacctattaaaggaaataggcaagaaaactatgttgatagagttgatcccaatttgccttttcattttgacagactagatgtagtcacaaatgaagtgttgaatgactcacttgttcaccagactggcagttctcatcactgagttacttcacattgattatcatccaggctgaataaaatctaattacatccttttaatacaaacatacaaggtggtggtagaaaatccacataaatttaaaacctgcactgttcatctctaaagtatttgggagttaaaaaaaaaaagtctactattttctgtcgggggttcatgtctcagacttcacctatgttatctctgtaggtatttcaactggaactgagaagtttaaggagattattttaaattaagtcattattcatcataaaatggatttcagaagcaacccaatctgccaatagcttgctgtccacctacattgctgaaagaaaaccttacccaggaatggttatttttactaaacttgtctcattggagtttaatgtgattcttctattaataacctcaaaataacatctcctgaaatatttaaaaatatggatggattaggatggaggagtcaaatatcaagtcaaatacagtagataattcttaactataaaattttaagatagaagtgggaaggaggtatacaactatatcataatctttttgaggtgagagtgttgtctttgtatatttattcctaacctttgatatagtatatatatatatacacccataggcacccattaaacctttactgaacgatatatttctataaaaattaattatttccattttccattttaaaatctgaatggcgacatttgcaatgacagtatcatgtgtcaaaattccatagtacattttcctgaaatatctacagacacttcattgaaaataaactggttgtaaattaaaacaacatgttaagtacttctgtaactattaaatgtgaaagatgtcttcagttgtttcgtaaaaacttcactcaaagggtacttcagatctgccttaatttcagaaagttgtttttaatgcagattttagaaagtcagcatgtgtgatagactcctggataagtaattaagtcataaatggcactctaaggtcataatataacagtaggtggattaagatgaaatactactttcataaggaaatactccatgtcttgtgatttatacacacaggatggaattgtgatttgggaatttagaggaacactcaaattatctggaaacagtattttcttacctgttttgcctatggcttaggttcatcaaatattttattttacccggaattgtgaattaaagaactccataagtgctgtaagtataaacacaaactatattatctatcactagttaccactttatttagaaaaataatattttatcatgaaaattttgcttcacattcataaaaatattttccaactccttctccctatggtattaaaaaataaaaaaaatctttaatatccagtctttttgaagtcaaccttttatgagaaaataggccctcaaaatttggacagataatactcaaaccacaattaacaagtctctgttttggtctgaacattctgaaccaaggtatgagcccactgtctccaatacttacatagagaaaagtaattatcactatcatttcatggtgttggatatccttgtttttgaaaaagaaaaacttaaatctaagcacatacatttagaagaaggggaggctccaaataactatgttaagtaaataaggtttttcaaaataaacacaaaacaattctactctcccaggagtagaattgtgttactcttgatagacttgaatatctgctattgatgacctttgttatccacaaatagcttaagacaagtagtccttggctttgcccttaaatttgccctcaagcatgctgattatggaactgagtgaaatagaattgagttctgtcttagaactcaaacagaattaggaatctttgtaagtgctcaactggcttaaatacttacttccattttaaaatattttcttctctttcattcattaaagaaaatatttattttcaactgttttatatttagccttaatcattttcttgaagatgttcgtacctctacccttatcccctctataatctaatcctcctcaggcatttgattgaagtatcatcagctatttttagcaggtcactaatggaagcctgattatatttctaaaacttatgtttccagaatttctatttcttcttattatttgggcggtcaagttttatttggggcaatgtttaaattcataaagcaaaaagagaaagaaacatcctcctcaagatttcctatgcaaattcaatctgtgtctcaaggaacttgcatggatatggaatctcactggaataagtcattctacacatgattcaacatggcattccatctgggttcatcattcagatctccaggagtatagtaacagggaaacaagatctgtttcttcttaacctaagctggtggcctcacaattagaagtttcagtgatgagtagtagcttaataaatatttattaaataatacgccaaacagaagcattactgattttctttgtggtatcatagatatgttgctctcatttcaaaatgtaattggctaaaagcttggtaaatagtgaaatttattttaacagcagcagtagggaatatttttatagttagagtaacagccaaaagaaaacaaaataatcaagagttatataatttatgttttttctgccttctattgttttttccatagagatggggtctcactatgttgcccaggctcgtctcaaactgctggcctcaagtgatcctcctgtctcggcctcccaaagtgctgggattacaggcatgagccactgtgcccagcatgcctttttctaaagaacatgcaatttccatttgttcttttagaaaagaggaataaaattagtctgtataataattttaactggtttgactattttgactttgtatcaggataaatgaagttgtccactacaaaggagaagggtagtaattgagaattgaacacaaagaaagagaaagcccagtgaaaacctaaagggagagaaaaggaaagagtgttgagaatcagaatgggacttgtaaaaagttaaagacacataaacatgagattcacagaagtccaagatagaaggacagtatcttgaagtaggtttttgtgttttagagatttcatctagattatacgggcagccctttgtgcacttgcttctgacccacctggctcgccagtacacgtatacttaagattcgtaatgcacatgccaagacatatagtggagttgagtgtaggagtgccgttgtagtttcttgtttgcctcaaatataaataggcactatttaacactacataaaaagtatagttctaaaaaatttatttaaaatttaccaaggcctctttcattttgccataatctcagtagaccaagatatttccatcagattcctcagcaaaaatcctgaaattgtttaagctgtgtgatacaatgtcagactggtgatgggattaaaaataaaatgctatgtgaagtccccaaactcagggcttctgacttagaaactacttgtatatgcagtgcaaaaattgctgttactccaaccagccctagccagtgtgattgacctaaagcaagaggtctcaaactgcagtgggcacaagaatcacctggattgcttgtttaaaatgcagattcctgagttccatacccagaaattctgattcaatagatgaggtgtagggcccagaaatctgtgtttaacaagcacctccacccccatcctgagattcagtagtcactagtactgtgagcactagtagttgaagagataccgtgccctagggagttatcttctcttatgctaactaactggtagctagttgtagccattttgaaatagtacttctccctccaccatcccttaggagctaaactgaggagatgtttccagtctcttgcaatagaattcggcaattgtgactcgattaccagggctctagttcagtttagtgtgggttaagtgggcattaaggaatgtgtattagaaattaaaaggttcatgtaaccttatctctgtggggaaacaaaggatgtgtttaggataactacaaaatgtttgaattgcttagataaattaagaacagtttaaacttagaaatgaccttgtgcccaaggttggattccctctgattttgctgtgtgaaattccatgaccttgtgaaacaaagtggtagaagctaaagctagcattccagtattataatattctaaaaactgaggtattgtgttttgtttcgtttgacctgtatatgaagattattcagtttccacccccatttctgcaaaaagagtataatattacagacaaaaattagttccgctgatttctgaactatgctatatcttgtttgctagatatcagtgttataggcaagatgtgtccctccccattttctaagggaggacataatgaacaacatgctttctctattctctctcccaacttgttccttcttttctcaatatgactcaaaagatactacaagatgttgcagataaaaatctgcactaggctagagatttaaaatattgctgatttgttcctgctgacaatatttattagattcctcaagatccaaaataaaatgacctaaaagagggtacagtttgttttatccaaattgttattagtttctcaggtcattcagaaacatccatctcttccagtttcttaactccttggcatgtggcttatgctcaggtgtaaagtcaccctttcatcacattcactctgtcttagcttttcgtttcttggcattttgtgttgttaagcatgcggcctcctcattggagcaatactagctaggctgttccactgtctcactgattaggacatggtagcatatatatcaggtcaatcaaatacccttctggtcagaagactagagaggttttcttcatgcttcttgattagatgaatttgaggaaagatctcgtatagaaataattttaattttctcaaaagaaatggtaattttacatgtatatggagaatattttaacataaactattctgattaaaattatagatgtacatatacaagtatagtggtgggaaaatatttttctgcactgtgtgttattgtgtatatttgggagattaacatttccaaacaaccaaagtttaaagcaaaaggtgtcccatttatggccaagtagacttgcatgccaacagaaagacattgtattaaaaccatatgcaattctagccatatttttctactttctcttcatgggtattgcatgatggtatttctaatacaaatactaatatgctttggaaataatggcactcgcaggtctttcatcatattgtatcactgctttatcatattaggctaatacactgcgagagttggtagaacctctccatgccaaatcggatccacttctgttggcactcaacccattggactcacagattgataagctaatgtttagagaatttagatcggagagagtcggtacggcgcagactcaacatcaacctcttgcaagcaactaaaatggcctcgtccttgctgtttataacagaaaacagacttgtaaaaagcttagatcatcaagtgttttggattgggggcctcccaaagggatataagaggggcaggccactcttaagaagaatgcgagctttctacattgggactagcataagatcaaagccaatcaagatggagcacagtaacagaaaactgcggtttctgtgggagaacagaaggggaaagggtcttaactgggaaagggctctgtgtggtaacacctcagttgtgttctcctgacaccaggaaaagagagggatcagcttcaataactagaaaattctggctgtttaatggactctttggtggcctctttaaggcaaagcagagaaagcaaattatgtattaagtgtattttgcatttttaaaacttgacgtgctgtattgtactaaattaagtgtaatctattaaggcaaggtatacacaatttgctttgaaacttactatgtttattctattataaagtgtattcaggtgcaacacagagactgctttcggtgacattaatgaagaaaatttctcatgccaggctttattatagaatcttcagctaaaatcctaactttctccttatttcttggcacttgtatacaagtggtgttgcctcttagggcaggcatgagctattcttttctgtaaaatattttgaatctataggctgtgggtttcatttttgaaaagtattttgtctggatgtctttcaaactagcttcagatattatttaatactatgtaactgggtcccctatggctcaatcaatattgcttatttttcttctgtagtggatgtgaaatttcctttagttggataagatacactgtaataattttaatgctaattaatgatatttcatactgtgcaatgaacagataatttaacactgtattttgaaatgtttttttcttcctgtcaccgcagtgtgtggtattgcataatgtgaatacctgtaaaaatataaattacttaaaaataaaaatatgaccaattggtatcagatcttttcagatagctaaataatttgctaagtatgcctgatagtaaatatctttctaaaaagaagtaatcagtgcttctttctcacaaatggaatttgtgtctgtgaataaaatcacattgatctgccttacaattgcctctgtgctctaaccattttaatgtgttttttaaaacatatatatataatgatggttctggtatatagaaatccatcaaaaagcattttattggctttattggtatttaatatttatgggattgtcttgggtcattctccctgtttaagccatagtaaaattttgtgatctagagaatttggtgttttttttttcattaaggaatatagtgactccacattaattttcaaaaataatcatctcttagctttggttttaaactgtctcctttatgaattcctgcctgagagccagcactttgacttccatattcctagtggttaaattttctaaattctgtgggtaaacctaaactgtcatttatatttttgattgtccttcaaagaaccttcccttctttggggcaataaatcaatgctaaggacaccaaggttttgccatctgaactacttgtcgtaaatactgtagtgccctgaaaattcaaccactgtcatgtatttttatcattaaactgcataatttaacagaaattacatgttcagagaaagaagtatagaataaactttagctctatctcttttgtcacatctttatggagcaatatttagtgttgtaaggaaggaattgacagacacaagtacttgatttcagtgaagcacattatcattattacaaggatgggctttacatgttctttaaaaatacagttagcaaatgttggtggagtcactcaaactgttcttttaagagaaggggttttttctcactaaaatagacttctttactcagagaaattatttcccaatagtaatgtttgtgtattgttactttgcctaaaagaaaataaataacttacccctaaatatgaaactagtagttgattacagatggaggactaaaagccagcttttaaaatcttatgctttttttttgatataacaaactgccttccccaaacccagttttataatgctaggcatagctgattgacttacataaaagcatgaattaagagagctagtatttaattacaaacattcaaattatagtataaacccctgaatacttaatcatccttatcataaaacctccaaagacattaagtccattaaaagtttgtcaccttacatataaataaattattcattatggcttgctagtaaattcatattcatggaaaatattcgggtgttctcaatgcaaatgttagttgccttttgtgacaagaatagtgtttcacatacttgatatcattagcccggaagccttaaagcactctgcagctgtacaagaatgaatgtctctcaaatctgactatgtccagtcttctctaccatttgtgatttagtctttcccaaccttctgggctcattacacagctgtattgcagaaggaacaactgtttccacaaggatatcattgtccaattttacaagatcacagatcccttccgaaatatgtaccagaactcgttatccatcattggcttcattcttcaagagcccaattggtttacttatttgttttgttttcattttttatgctccttcaacattgtcattgcagggatgtgaaaatggggtggatactagagtaaaattttaggttgccaagtttcatgaacaatatgatacaatagattgtcctaataattacacagtcacctgttagggaaccctttttggagtagttcatatataaagaaaaccatcactctgtttgaatgtgttgggttgcatgaggcactgtgccaggtagaagaaggggaaatgcaaatatgagtgggacaaattctactcgtggaaaagtcacagtctaagtctctgaagtagggcacacaagggtccattaaggtacaggaagaaaaagcattggaatttttccttgggttttatctctcatccttttgaatttctttctgtgtatgttttataacttctatctattactatagagtaatacatgtatataagtttctgttcgataaaacggaagtgttttaactaataagagtgtgcaatcagaaaaagtttggaaaccactgagcctgaatgtaagaaatacgtcaaccaaagactttttggtatttgagaaatgcattatgatcttctaataagcaatgtgcaagagattccaacaaactggtatttttcattagctattcttttctttgggctttcagttatcacttactacctagaggtcataggcaacctgaaaaagacaaataatgatgctcactacattcctagattcacaatatttcatagtggagcagaatatgaaagggacaataaagaggatcttctttcaccccgtcaagtatgacacagccataaatgaccctccctcggcacagaatacaagttaattcatcaataacttaattatgatcctcaaatccatcaatcaatgaaattttatgtaggaaagaaaattttatatgcactctttgcttcaataaaattggaattcaaaagtatgtaatctgacacaggactaatttacatgttgtaaacgtaaatataatttggggggaaatttatttctgcataggcccaggtttcctgaataaattagatacagattaaaatttcattatagcagtgatacagttcctcattaggaatcacagaaggttcctatatatgtcctgtgatttgaatgtggtctctacactttgccaactttcagaaaacattcattcaaattgcaaaagagctggttttcagccagtgttccagtggctgaactggcacattgaaagaaagtcaatcaggaagcagacctcaccaagtgcttgcctcctcttccaaagcaagcctcttctaaaggaagaaaaagcaagggttgaaaaaagagagaagcctgaagagaagtgagaaggagatgaagaagagggcaaaaagagaagaaaataaaggtgctttcatattttcagttgcaacagtagccccaattgacttaattggtattcatctgagaaaaatcaaggaaaccaattgaaaattataaaagaaaataaaggtctgtttttgtcttgaatgttgagttctgtgttgttttgactgttgagcacagtgaatcagatttataatgtgactctgcccctcaccaaccgcccttttgaaaatgaaaagactctttgtctagtcttaaaatgttaagtaattggtggcattttgtggtagcctggcatctcagtccctcgtccttactcatcccactactgtgtcttgtgtagtgtatgtgtatgatgtgtaggggatgggggcagggggtggcttattatctctgataggagccacactatcccattactatacttggaaatgtttctgtgttccgtctcattgtgattgcttgttcaagtgtgctgcccagagataaatccatactcaattctttttacagctgtcaaaccagattctttgtagaattatgttgtcttttgattgaatgcttttctcccccgtaagagcaagaagggggagaaactttcagtttttattgtttaatacctatgtatgtcattttatatattgaatcttcattcatccttcttaaagtaaaactacattgaaattttataaaatcagttatctgccccagtatttcacaagctttaagaactgagggaaaactgggtcaaaatgtttttttaaacaaaatatatgtacccttctacaatgttaggtaatatggaggaaggttcttttaaaataaaaattactatgtaaaaatactctgcctcccttaaatcctaaaactaaaatctgaatccctttttccttcaccttctttctagaaccaaaaaactaataatacattaggccacctgataccttaactactataattcacatctgttaggcctcgcattttctaccccaccctctactctatgaaattacatctggctttagatgcagtattgccttgaggaaaaaaagaatacgataactactatataattcctcagggttctttcctggcctatgattttctgaaatagacttatgctgtttaaatgtgtccttgtttttacaactccatttagttattctaaatgatcatatgattttgtgccttcctcaagccaaatcattctcagttaagattccctatcttgcttccattttgttcataacccacaaagcagtttctcctttttacagtcttccatcccccatccctcaaaatcctctaggtgttgaatatattcagcgatgggccaacagagaatttaaaagctgttatttaaagtgatttttgtatttttagattatagttctaacttagatatatggttaagaagttaaaatttatcacagaggacttagtgatagcatgtgctgatgataacaaggaattttctaatagaaggactcaatgactatacctaccattggttgttaacttcagtagcagagccaaaagttgaatgtggaatttaaataaagctgctttttaatcctaaaaatgacctttttaggttaaggtactgtacattttgggttttttgatagttttagatacagtcattttgaaaaattttttgaatgctgcattttaagggcgtctcacattcattggcatctactgctaaatacacatttcaaaagacaactgaaaaaaattggcagtatagaattcttgttaaaatcgtggattctggggtcagactgcccacatggaattctagctccgccacttactaagtgtgactttgagcaagatactgccctgctataaatgaagataaaatagatctgctcttagtattgttgtgaggattaaatgagatcataaagattaagcatttaccctgctgcctggcacatctaaatgttaaatggtatcattaccaattaaggaatctttttttgaaactgtcagaaagcctaaaatattcacatggaccattgtggaatgaacaacattccatatttactctttgggccaatataattatttaaatatgattctggctatctatttaaaaaaagatgatatagccctactccaatctaccactccaagcaaaatcctagttcatctttgtttatcattgttgagaaagatacgacattagtgttcaggcaattataaaaaacaagatgggagttttatttgttcagctatgtctaagacccttattgagccagtctctcatttttttctcaaaaatatttaactggagtattttctcctcaggtcttacaaatactaagtagcttctcttagcacgtgccatattttccctctatatttgcatataaacatattcccatgtttcattttaattaaaatattgataatttatgatcagttactatatttacaatgtacaaggcattactatggcagtcacatgaaacctagtaatcctctatggcacaattggaagatttttacaatcaaatatactccattgaatgccattcaatcttatgaaatctggaaaaatgtaaaaatcagttcattcagtattgctaaaccaggcgagctctattaatcagcatttctatgcttatcagcataatgataagggatgtttattaatgttttaaaatataatgtgcaggattgtttccatgttgtgtgccttttgtattctaattctttgaacttgctggactcaagatatatatggcaatttgctatcaagagtatatttggttaatcaaataatcctattatttgatcattctaaaacaattagctgcctgtagctaatgttacccaatataactagcagctgtgggtttttgttgttgttttttaatataatagtgttctcatggtcattcattatcctgtttttcagatagttttgatattttaataaattttccatgtgtcaaataactatattgcaatgaattcatttctctttctctctctctctctctctctttctttttttttttttttttttttttttggatgttgcaggtgaaagcagagaagaaaagttaggagactcattgcaagatttatacagggcactggagcaggccagtctgtcaccactaggagaacatcgtatttcaaccaagatggaatacaagctatcatttataaaaagatgtaatgatcctgtaatgaatgaaaaactacaccggctgagaattctcaaaagcactttaaaggtaagacaagaaatggaaggacaaatttctttgaagagattcattcttaaagtggattaccagatactgtaggttaagaaatacaaattgggggctggggagaagaagaggcaagcagtaagaacttgaagctgagctatttctatgtcataataactatattggtaaagaggagatcatcttaacttttcattaatgtctcaaagcactgattaaatgttattttactcagttctaggagaaaacaggatgtgatttaaattgttttctaaaaatgcagggctggtgttattcctcagtctatagattttctaagataaaaataccatgtagtgtaattattagcattactaaaagaacacagcatgcatgcagaatacaatagtgggtgctaaaagagtttgagatatttcgtgattgtttcccgcatgaactgcagtgcatttgggatgaagccacggtgatttgtgttccatgtagaaattttataattgttctgtttacgttatcagttcccaacttacatattaccctcctattatacatttctgtaagtgtttacattgcctccagtctccttattatatgcccccaggttggggaggaggtggtgaggacaggagagcagagaggcagaaagttggaaaaggaggcagacaagtgagccctgctcactgtgtgtgggggagtgtgggagattgaaggagagggcccaccgcacaagccacctgagcaggccctgtgcccttataaaacaaaaacagaagacatttatgcagccaacaaacatgaaaaaaagctcatcatcactggtcattagagaaatgcaaatcaaaaccacaatgagataccatctcacgccagttagaatggcgatcattaaaaagtcaggaaacaacagatactggagaggatgtggagaaataggaactcttttacactgctggtgggagtgtaaattagttcaaccattgtggaatacagtgtggcgattcctcaaggatctagaaccagaaataccatttgacccagccatcccattactgggtatatacccaaaggattataaatcattctactataaagacacatgtacatgtatgtttattgtggcactgttcacaatagcaaagacttggaaccaacccaaatgcccatcaatgatagactggataaagaaaatgtggcacatatacaccatggaatactatgcagccataaaaaaggatgagttcatgtcctttgcaggggcatagatgaagctggaaaccatcatcctcagcaaactaacacaagaacagaaaaccaaacaccacatgttctcactcataagtgggagttgaacagtgagaacacatggacacagggagggggaacataacacactggggcctgtcggggggtggggggctaggggagggatagcattaggagaactacctaatgtagatgatgggttgatgggtgcagcaaaccaccatggcacgtgtatacatatgtaacaaacgtgcacattctacacatgtatcccagacttaaagtataattaaaaaaaaaaagaactatcatacagagtatgtgctgtagtaatttcaggaaacagaaggtcagagggctcctttgggaaatatttcagatccatagcatgctgctgaggttttgtaattttgaaatataggtgagtaccaaagagacagacaaactagaaaatgacctgaaaaaatttcagatagcaagcagcaaagttttcagactccattagcttttaattggtagtcatgcaaatactactgcaaatccaggggacaatttaatggacttttgggaagagcagaatttttagagagtgctgttaatagtcgtaagaatagttgcagtgactaatcctactccaaagatatcatcaccctcccaccttatagagcctctccacttcccccattcagttctaaactgcctggtttagaaggcaggcaggcattttgaagcaggttagattcatggatcttaaagacctgtttctctccttctatctcacagccccttttccctgtcttttatgctctgtagagtcccccagggtattttcttccagtgacaaaatatatggctactgccaatgttcagttcactaagtattgatgaatcaccaggtacatgaatgctccactcgattctctgggaccaagaaagataacgaaaagtcactgtaaaaaatgtccctcattggtacaaatgaactacagaaccctatggtttttggcatggaaaattaatagggaatgaattccttcattagggaagcatagctggccaagcaaccctggatgtgtctatttcctggaattttaacagtccccctcaccaagcacagatctcagatcccaccacaggcaactcacaacatcctcagtcccagccctcttccatattctggtctgtgaggccagaccaacttcttaaccaccttactgttttctttgcctcccaactctggctggcccagaggtgtatgccttacttcctgcagaacattttctacacttccctaagctttacttgggtcaggactgagctgctcagactttcttaacccctacttctccatcccaccttccacctgggaaattctcatcttccccaggtgatagttttaacttggtgagttataccaaaatgaagctcagtcttcagctgagacccagcttccaacatggaagggagagccattctccattacaggcccccagtgctacagaaagggagccataacattcacacagcaagaattatgtatttgtggtaacaggggggccatgctcagtctcattcaagtatgagaagcttaccataaagcaggagaaatagaacacatgcaaaagtaactcaagaaatagaatatgacaaatgtactcagtggcactgatggagtagtaaaggggcataaatgagggagaaaacttttctgagtgtttaagcacagcttgaagaaatgagaggcttttgaactggatcttaaagaacgaaaaaggtttccatagcagagatgggcaaaaggacaggcaaagagaaaaagcaaaccacacagtgggcaaaaggaggcgttcctcgggtgtagaaaaaagtacactaggacgtgagtctaaagagctgggtgggtgtgagtatccaaagccatctcctatgggcttcttaaatgttttgcctattaactttttattttaaacttgaataaaactttgtccctgtcttaattgttgaatcctttttcttttcaggccagagaaggggaagtagccattatcgataaagtcctagacaatccagacttgacatctaaagaattccaacaatggaagcagatgtacctcgaccttttcttggatatctgtcaaaataccacctcaaatgacccactgagtatttcttctgaagtagatgtaatcacttcctctctagcacacactcattcatacattgaaacgcatgtctaaatgtattctgccttcagaccatctagtacctgctggtactctgaacaagtatataaggtagtttttatatcaatgtgtggaacacttgacaagctatactttaatgttaccaaactatatgaaacaaaccatatatggtcacaataccactatctttaatgagcatttgtatattttatatgcaacagtgctcagcttatgtttaccatgtgcaaaatcaactgtctttaatgacttaaaattaacttttgcaaacaattctaaatacaggtggtcttcaagtagtaaaaccacaaaaggcagttttctatctatggtcatcttttctccctttaagttaattttatataaacaagacttcaaaagtaaatcacattttttcaggtgcagacatccttgtgggtgggaaagaatttaaaccttttttatatttattaaaatgttctaagaattttcttaaacattgcacaaagtttaatgctgtagttttatttttgtgaaatgtagatgcgcatacaagagctaagcaaaatagaagagcatcgacataagaaaagttcaggtatctaatattcgtcttaatagtctattaacttgtgaaagctaagttaatggaaatattattccaaatctatgagaacacttggtgtatcagggcaaagctttgtaagatgtttttgtaactaagaccaaaattgaagatagagctgctttattttcttggtttaaatcttcctttatttttgtagtgatgagatgctgattgtgtacagaagaatttgagaggggatttttaaaaactgacttaacacacccagaaaggcagctaacagctatatatatatataaatttcagcccaaactcatgtttttaaactccaactcttaaaagacaacaaggtataaactgaaatgaatcaactttccacttagtttccaattttcccctagtccactaattaaacttaggtaattatacttcaggtagggaagtacaatatgtttagtttcaggctgatgtgtgttataaaaaacaacactgaaaaataaaaatgtacttcccttctaaggagcaagcaggtgatggtcattcaaagagatgtcacattgaattatgagagaaacaatttagaggtttttttcctggcttcatgaattgttctatagagtggatgaagtctaaggaaaagtcctcttcatatatttccatttataagcgtcttgtttttgaaagtgatcacagcatgaaaatgactgtgctgctttttagtgtctggctgcataatgtacaagtcacaatttgctgtttttttcaggaggagaaagggaacctcctttactattctatatcctaaaatctacttctaatcagctttatactgttgcctgtacagctcagtgaatgtactttcatctttaagagttcagatatatgccagtgaatatttttgctgtagaggagaaagtaaaaactccacagcggggatctttttctttgcttttgaaaccaccattgaatcactatcgttttgcagactttgcacaactgtacaggagagtggcctttctacagcacattttcagtaatcctatatttagtcaaaatggatgagaaatcatgtattaatgtttgtatggaattttgggtccagtgtaatatttttatcatttaaaaagaactctatttgtaaaaacatttatttactgcatggatattgacgcacattaaatttgtgggattttgtatatgtaaaaaaaaaaaaaaaaaaaaaacaaaaaacctcttgtcctaaaatgaagtgtgcttgttaacaggtgtttagacttattgatgtttactagaccaaatgtgtatgttcacttaaaaatatatgtacctgatggatgtgtcatgtttacagtggccaggttgtggcctgtaaacagcaagcagttgacgggaagactagctctgttgctactaagcagcttttacttttgtaaagtcagctctgttgttttaaatggtaaaaattaaactaatgaatttgacaagactcgtggctagcctagcatgaaagagaccttttaacactatataatatctgtacattttattgcattcgtttcaaatctaggagagaggcagcactgtaaactgaagtcaaataaattcagctcttaatgaatcctt

SEQ ID NO: 5531 - DNA, 280276 bp, human; identical to SEQ ID NO: 5530

SEQ ID NO: 5532 - DNA, 268420 bp, human
tgctcggggcttcactcccgcgcgtgaggcgagcgggcaagttggctgagggcgtgcggcagaggctgcttccctcggcgacgcgacccctcagcaactcaagctatgaactgaagctccctagggacggagaccggagcggagcggcggaggcagcagcagcagcagcagcagcagcagcagcagcagccgccgccgccgccgccttagcgggaactgagcagacccggcgcggagccacgactcctgcacgtttacctccctgtcgccgttcctgccggcggttggctaaaagacgttacagccgcgagacccgacacacaaaagccgctttctccgcgccgcccgcccagggaggctgcggccagcaagggaccccacctgagagcagctcgggctgctgagttcgttttgtgtctgagctctgcgctctgcacggaaccgaccccgtacccatggctctgataatggaaccggtgagcaaatggtctccgagtcaagtagtggactggatgaaaggtaatgcccgctgcggggagggtgaggcggcactggggcgcggggcaccagtgcgaggttaggagggggcgcccgccgcgccagagcccgccaccgcggcttccactggcggatcgtcgtacgcgtcggggcgggggtcctccaggactggcaggggcctggggtccccggtctccttttgtctccagctagaggggcgcggagcggccagagagctagagggcagcgggcgccaccccgttggaggcaggaagtcgggaggcagaataccggcgcatcttgcgtactcccctctccccttactgcccccgggccaggaggacgtggcgacccttatctcccagctcagggtggactcccccaggacctgctcccctggtcgccctttcctggcccctttgttcctgggaaagctgacgccccctcggcggccgcccttgccaggtgccttccccagcgccaactctcccaagcaacttttagcccacataatggggtcaggacgcggccgcccccattcggagcctggcatccccccacacccagatttggctgaggatgcccagggtgggggtatgtgctactttgagggtgaggacatcatgcttcccctgggacagcatccttgctgctgtctctgggctgcctccagcgcatcccctcgcatcctttgccttctctgctttctccctttcaagccagtcgaggttttggacctcacggctttttattaagggctcaacgccagatgtaaggtgatgcgcattcaggtaccttcacatttcttccatcttgaaggttcccccttttgtccctggcgatttataataaccacagttatagacactcaccctcctaatcgcaaacgtgagctttttttctgatccctgggctttcctgtctcactacctccctctgttgtctgagttaaggggcttgtagaggactcccccacccaccaaccccttggatcctcaggcccaactcttccctaagattttgggaattgaagaggggatggatgggatggaatggaataaaggatgcgtggccacacttgggaaatgttagcgctttgctcgaggtcatacctgagcaaactctaggtagatcagtcagggaccaaaggcttattatcgctgaaaatgcccgttcctacgatgaaggagccccttcttgggcttacttaacagtcagactttctaagctccagataatttagaacgaaaggtgaggtgattgggagggattgagagtgacagggagaaactgattttttttgctcattcttttccccagcctttttggccgcttgcttattcttgtggatttttctttattttgctttccttttattcccttacttgcccctttattcctcatttactttgcttttcttttctaatatgtggaaactgctttgtaactgctaagcagtacaaatgtgagtgaattgaattaaacctaatacattatttatcgactgcacccctgtgtgcagtgcattgtgctaaggtgccatgggggatataaagatgactaagacaaagtcctgcagtggctcatctttgctgctgctttttctctttatgtatttgctattgaaattccaatatcttagattcccaccaattatcctcactctccaccttctccgtttctcagtgatggaagaaagagccagagtatatacaggaagcaacaatgcttaaaaccccgttctttgaatttgtctaaaaggttactttagtttgagtctgttgctgaaatattaaaagacaagctatcttggctccatgggagtctgattaccttcatagactacctttcgcaaattcccatgatgcctgtagtgagtgctgcatactcagtctccacctcccaccctcccagttatattcttgcagtttcccctctctccatagtttaggtccactgaagcaagtagaatatatgatgcacctattctgacacacattattagttgtccagtacaccagtcctttaaaaatctttccagcctaaaatgtggcttctttgaagttaggttaacattgttagctgtgatttgaaaattttttttaaatgtaagtcgaataccttgttttcatacctgttggtgacgcattttagagctatttgaaaagatcaattgggtagccaagatagtttgtgtatcgtgtatacatatgactggaagagaatgaatgatataattacctgtatatttcaaatcccagactacttactgctgaaatttccttaatattcatatatatttgatttgagatattatcagaaaatgagattttaaaaaatagttggatgaaacaaacatttcctcaacttgtaacttacactgttaccttaatttttctctctttgcccttttccccaaataaagttaaacaaaggacattttaaaaatatttttcatcctgcagtaatatttaaaagtcaactgctaatttaggctatagctttgagatggctaaacctcatttagtgttgtataatatgtagtgttgtaaaggcagtaccaaagaatgaacaagactgttgaacaactgcaatgtgggagttcttcagaggatgctcctaatgagacagtttcatcatccttagcattaaaagcatatagtatatgctttcagctggtcacaatcataaatagttgtaactctgtttagtaaggtacattctttatgtactttctagggtatttttttcttcactaaacagaaaaagaatcgctaagtgtgtaagaataggaatggccatatatttatgattctagacaatttgtagaagtggtatagaaactcagtcccagagagggaaatgaagggggaaaaaaagctgacaagattattaagctttagtggcatatattcaagattatttatgagggacaatttttacattgcaattttgatgcaatgtataaatggattcattttgattgatcaatttttattaaaatatttgagggagatggaaatataaaatgtatatattgttagtagtaaaaatataaggaaatccttgtattcttttgctcaccaacttcattatttgtaaaatcaaatactcaactaaattttctactgacagtaaaaattggatatgacacagtgtcaatgttatttccagtaagtacatgaactccttatgagtcagtgaaataagtagctatatcccaaattatcctgatagtacttctggctatttggagatatcttatagaccttcaaattaatttttaatattaatcttataaaaatatttttggagaaaatcaaatactcataatttagcatttgaaactgaccttcttcaattggaaattgcatccaatcctcttgtagtttttatattttaaaacataaactattttcaaggtaaatagaggcaaataagttattggaaaaagccataggcagaaaagtaggccaataattgttctaatttttcctccatctgttattctaaaataagttatttctcagctcctacctgttcacttgcagggcctggaaatatttcataatttgcagttatttgagtccccagaccatctctacttttttgcccactgaaatataacaaaaacccctgaatgctttagggcccctgttattaactttattattaattttcctagtccgtgtcacacccagtctttccatttttttttcttacatcttttccaactctgagactcattcaaaatatccacatgactaagttatttttctaggactcagctccctacattacattcttccagtaatctttaatctctctgggtcaaataaaatgattatgacttttcagagttaaccaataggccccattttgcttgtcttctcttaccatctctgtgatttagctccagccacttttgtattattatgattcttaaaataatctaaatttttaagatagccttttctcaacccattccacaatcaactgctctactctttcctgtttactataaatcatttcttcaagaggcattctctgacttctaatttctgtcctgatgactcagccatcttgaggatagaaaataaaatacattcttttaggtataaaaagcaaaaccaatgttttgtatacagtcctgtaatagaggaaaatgtagtgattatataaagtctagtcagtataaaagttaaatgctgtaaaggagaatgtgttggataaggcaaagatgttttgacaggtacaatactctttagtaattcttttttcccgtcataggacccagagctgaggttgaaatttgtctttgttacataaaggaaaatatcaaaattttgagttaaactgtcttgagagagagattggaaataattttctggcaggaactgcaaataagcttaagtgatcaaattgtatcacttccttttgaaaacttagggttttttttcaattgaaaggtgactaaattggcaccaacaattgtctactttggatttgacttttttggggaacaggaattcttgtcattttatgtaaagaagaaatatatcttttccatatgtagaatttcgttcagaagaaatgttatttttcttatagtgttattaacatttgctccttaatgtaacactcatgatttagtgcagattaggaacaaggagtatatttatgtagatatatttgctccatagatattattttctcagtgcttttgcatggagggtgctttaatgggttgttttaaattaattattctctgctttggggaaattagcctctgtaagggatggtagtgacattgacaaacttaggcaaagacagagagaggtgccaactagcacatgtagtaattttttaaaggctgtatatgagcaccattggaaagagaagatgataattttattgaatcaggaagggatctgtgaggagggtggggttctagcaactatttaagctacttatttaattaaggcataatctaagagggatgtatactaaatgtagcggcacagcaagaaactctagagttgaaatggggttattaactaaaggggggttgtatataggtttgtctggatgaaggagagaggtgggcagtagagggaaagtgagggaggagcatgagtaggtggcacaaaagtacaagaacaaatctgcatttcacaaagacaataaaactctcatcatgtcctgagtttaaataaatgccacattataaaactttagctgccaaaaataagcccacaaagaatgtgtattgaattggtacagctgtttcaaatctgtttttcaggaatgatttgaaaataatgttaaattattttgaagacaaatcattaacatgttgttagatatttcgaattttactgaaccaagttcttatatgaagaatggaaatagacttttaagtattaatactgttcttaaagcaatgataaattatcatttttatttataacagagcaaccctagattagggctcaatttgttctttttttttttttttttttttgagatagagtcttgctctttcacccaggctggagtgcagtggcacaatctcagctcactgcaacctccgcctcctgggttcaagtgattctcatgcctcaacctctcaagtagctgggattacaggcacccaccaccacccctggctaatttttgtattttttagtagacacgggatttcaccatgttggccaagctggtcttgaactcctgacctcaagtgatccacctgcctcggcctcctaaagtgttgggattacaggcgtgagccactgcacccagcctcaatttgttcttaatgacttttagctttctatgtgtcttccctgcagtacctcacacataagggttattgtgaagaataaagttattagcttctaaaaagagtactaaaagagtggatcatctgtactaattttaaaaaaggttgggggaagggagtataaagtaatttgaaaaaaattgagtctaaaagttttaattgttcatggctttttattgtttagtgtctgattaaaaacagcaagtatagtcttcaatgtggaatcattgtgttgaattacattcggtgagggaattcacagttttcatgtatagcataggcctgtattcctcaaaatggtatatttttgtggttgtggaagccaaatgatcaaaagaagccaaagagttgtgttttttttgttttttgctaagctttttaaaacattatattaaaacaaacatggatattatattcatgatgtagaaagcaaaattggcattatttcaaagatgagaccagagacttaacaggaattttaggcttgcaacaggctgtttaaagctgtattctccagacctcccagggctgagtacactcttttgagcaattacagatgcatcagtggaaaagttggagaagtggtggttgagtttaaaaaaggtaaaattaatgtactctgtttccctttttttcctattaccacaaggcacaaaatatgaccattttcagtcgaggtcatgataattgtagcatcttaattttgtttatttgtttgatccatacacctgcagtcaggatgaattccttgaaaataaatctcatccgatctcattctctcacttcttaccctcatcagtttaaaacaatttaatgacttctcattgtttttaggataaaggtcaaagtccttaacatggcctataagactcttgaaggtttggccattgcctatgaggtaagcgtcatgcccagcaccaagtatgcaggctgcctcaccgtccttcctgtttgcctaccactggacatttgcacttaatatgttccctatccctcttcacctagttaagtcttactcacccttcacgtcttaggctttttctcatccaccttaggaaagcctttccagatttgttaaatcacatcaaatcctcagttatatgctgtcctagtaccatgtatatctcctgtgtcccattcaccagttttatttttatattaatttggatggttatttgatatccaactcccccactagatgagtgcagggaccccatctatttcttgtaccagtgtgtaaaaaagtatctggtatgaaataggcacttagaaaatatttgttgagagaaggaataaattaatttattcacagattactggtctgtcagcaaatctgctttcctaaatgacaatgcacgtaaagtcccttataatgctctaatggatacttcagtgccaacttgtatattgtgtgccagaatacagtagaagtagggttgctttatccatttctcatagttgtagtgctctagccaattcaaagatacgaatcatggtttaaacttattttgttacaaaatattaataatttcaggaaattaataacactttggtgtttatgccatattataaatagtataaatattacttactaatatcacttagtaagacaacatgataagcaaatacttattaaaacattaaaacacactccttctcctaagcatttatttcccttcattcaaattttctaattgtttcttcatttgggtattttttaaagaactctatatatcttagaatgcatgatggagtgaaattgatcagatgtcttaattttgtcctcataaaaataaaaacaaaaagctcatataaaaaattaaaatgcattattctgttgtgaggatatcctttatttgttaattgggacgataaaatggaaaaacaacccttgggcttaatgaaaccattatcttatttattatatttagtgttcaatttgcatttttattaataggaatacaattaaggtatttaaaggtgcatcttaaatcagcattttcttgtgtaatttttcaccgttccctctgattttgaaaaaaagaaaactttaaaaactagatgtaagtttatcattactaatttttgaagggcacttgttaagaacatacgtacagaattattgcaaagcatagtttgctaaatacaggtgcctcaagtggattttctatgaattacatgctgctagataatcactagtaggcaacttaccaaaatttttctaataaagcctgcctcctcccaatttagaatcattaaaatacaaatcagagtaagtgaaattgtaaagatcttaataggcatgccagtttgttaactctttataaaacaccatcaggcttaaatgctctagctagtactgcaaaacaatggattgcaattgtgccctgatttgacttgcaaacaactattctacaagatggaatttttaaattttaaagatgtatttaatttattgtttgattttaatttaaatcacaatcattaattctaatggaagttttcattatcttactcttgcaatttcaggaaaaaagagtttgttgctatttgcataaatgcattgaactttaaattttactaaagtgcagtaataactgttttagctctctttgttcatctgttgactattttaccacaacataaaattgtttgaaaaatcaaaatttatttagtaaaccaaaacttgcactgacaccaatatatgatagtttgtcatgataaaaatattgttacataactaatatcaagtatagcatacatgactcttatgtgtttacttggcattaatgttcttagaaattaagtaggttggatggtctttagatacagtggtagataagaagaaacctcattaaattagttgcgtttttaaatgttgctcaatatctttttttttttttggtgtttgtttgaactttttattttgttccagatacatctgctatttttaaaacaggcttgcaacatgttttcttaagtaatagctagaacaaatcgatggaagcctggcttagatcctagattttccttttttcaacttatttaccaaagattgtaaaagaatctattttctagtaacttgttagttatacttagcaatgtaatttattagtaaaaacctttaacaatgctggcattaaataatacagctgaatgattaatgttaacactggctgaatttttgttttaattttggtgtgttttttatgtgtatataggaacttattttgtatattttttcagaaaattgatattttaattttgtgaaaatcatttatattttggttttcaaaacaggccattgggatattaaatacatataacagagaaagtgtagagattttgctcatgatgctcaaaacagacatatagtagtccagtggctagttttcctcctggcctgctggaacttacgtagaaaccaagtttgatgtggtatagagctagcatgatatggcagggctaggtgctctttccccatttcctattatattggtgtcaggatgagctttgtggcagtctctgttggcactaatgttacattaaatcaaaggaacaaggcttccttatccagaagcctgctctgttgccttctagctgtcagaccagagactttcagtttgatgttgaattgacacacacagagtagttagttctgtgaaatatttgggttagatgatttttctttccagtggccctagacataatgctttgagtttatttatggtaaaaacctgttaattgagattctgtttatttgggatttgtgataatttcactgtgctcctattgaagattactgttaatatgtgaaggaaaggtttgctgatcaatctaataatgcaaacaagattggaaagaaattgtttgacctgggagaatacaatgtttttgtactatactttgccaggagccacttacatactgaaaatatgctagttagaaaggagctgtatttttacttagaatttctgtatacttagaattatcagtctttattttttggagtattttccaaacattatttaatatagcttggttcttctcattcacccaaattggaaaggtcatgtacttcacattatattattgctagtaatctttaaaagtgagataagggagagttattaacacctttttataggtaaagtacagagaagttaagcagctcaacagagattgtacagctgttcagtgaaattaggtttgacgtcaacttttctcctactggattggatttacaatttagtgggcaaaggacacaattcagataggtacacaatggttttcagaattgaccttttaaaatttttttctgaattttctaccctttaaaaattggcataatatgtaatatagtacaggtaagagcactttggaatcatgatacctgggtttgtatcctgactttatcacttcttagcttgtgtgatcttagggagagtttaagtaattttcccaagttttctcctttttataaaatggggatgctggtattacctacaattaccaatctaaaagatgtttctacattttgccacatttttctgttgtggtatacttaaaacaatgccttgtatatagtaagcacatataaatgtcaacttttttaaaggaagagattatattctgttggcaatattcagaggcagaactaataatagattatatttattaagtgcttactacatactgtgtcctgtgctaggtgctttccctacattacatttaatgcctgtcttagccctgaaaggttggacttaatccctattttacagatgaaggaactttggcttagagagatttttacttagaaatgttgaatgacttgtcctatatacctgtatatttattaagcaggtgtttgttttaagtattgatttctgattggttccaaaatacctaatatttccaccttgcttttctagcagaggtagatgtgacgtgagaggaatcctggaaatacttttcaaagatgtgtatgtcctctccatcagacctaccttctctagtatctggtaaggtgggctatagtttttgtgtcctttgggcttctagtgagatgtgcgtgtgcgcgtgtgtatgcacgatgagttgtttctacttctcaggatagggctttcattagtgacaaagatgccacatattactgtagtcttggtgacagcttttgtattttgaagtgacccctagagtttgatgttcccctctgctgagtctggatgtaggcaaaaaaaaaaaaaaaaaaaaaaaagcctaccctgagcactactgccaagaacccagtgctgagatgttttgttatcaaaggattgttaatatgtggtgcctgataatagacattcataagtatatcacattttaccaaaaataatgatgttttgttaagatttactcagcagtggttagccttgctacctgcatttcattagtgtttctttgaacagcagacattttttggtgcgttcctatggatccgaaacccttatatacctacaaaatgttaattcatctcctcaaattgttttgtttggagacatttatcatagaccaaattgtgatatgataggaaagtttagtgaatcacgaaagcaattttaatgctagaggaaatttaatcataattagttaaaaaactattgtgaaataaatgcaaaatatggagtggtcaagttgaattagagatatttgaccaatggagtgcttgtaaaatggtaatgaaaggcacaattccatctacattatatttgaaagtgatacacataattttgtatatgttttaaaaatatgtattctagtatatatgtggaaacttaagtaggatttgttcaaagttatgcaaacatgatattttctgtttctccttgctttcttttaatagaaagagttaaggtgagtttgcttcagactggaagtgttaaaataagtgaaaataacttaaattgttctttacttgtggagagaatggtttgaagtttctcactttttataaaagctattacaatacccaggacaatagaaccttaaaaaaaattgtgaactgtggtagattaccaaccactttgaagttaccttagtcttgtctctctgactctgtaaagcacctttttctcctaaattgctcattatcctttaaaattcatatgaattaaaattaattttgtttggggatgtttttgagaatttcatcactttctttgaaataattgttgacaccttgttttaaaaaacaatctggtttaaatatggtaatactgtgaatctccatctacattaattttaagatgtatctgatttaatgtttaaaggcagtggtttcttatgtttcagattttcaaatgaagctgcttattcttaaacatatgcatactggaaactaatgcatgcacatagaaaataaatacagcagcgggctggatgtggtgtctcatgcctgtaattctagcactttgagaggttgaggtgggcaaatcacttgagctcaggaggtcgagatcagcctgggcaacatgacgaaactctgtctctacagaaaatacaaaaattagccaggcatggtggggcacgcctttagtcccagctactcaggtggcagaggtgggaggatcaccagaaccaggaaggtcgaggctgcagtgggctgtggtcgcgccactgtactccagcctgggtgatagagtgagaccttgtctccaaaaagaaaaagaaaagaaaagaaatacagcagaatagctgaggaactataacactattatcacgccaccgtccattcattccttaatatcaatatctgtatgtacaaatttctagtttcataaatgtcaaacacttttttttcttcaatcagaacccaaatcaggtgcacacattgtagtctagctcattcttttttcctatgtcaatctttttggatgttttacataacagatgttatgtaatatctcctgaaataaaattcagataatataacctacctagtcacataatttttttaaaactcactaaaatgcccttattgtaataaaaagaaaaacacataataaaataatatgggtttctatatgtacatactcagtatgactatacaagaagaaaataattgatatttttcctacttttttttttgtttgagatggagtctcgctctgtcgcccaggctgaagtgcagtggtgtgatctcggctcactgcaagctccgcctcccgggttcacgccattcttctgcctcagcctctcgagtagctgggactacaggcgcccgccatcacgcccggctaattttttgtatttttagtgtacacaaggtttcactgtgttagccaggatggtctcgatctcctgacctcgtgatccgcccacctcagcctcccaaagtgctgggattacaggtatgagccaccgcgccaggcctatttttccctacttttaatgaacatatctggatttaaaagaagtgttaaaatcagaagttgttccatagagtgtacaagagaaaatggaagaacagatgaactaatagacagtgaagtaaaaacaaatattaggagaaatgttaatggaccagactcatttgatgagccattctagtaattcctattgaacatttgaaagtcatgagtgaaggaaacagctttttggagaatgttatattctagggctgggatagggaatatgcgagaagagcctggagcatcctgtagtgccataaagtaaggaagtgttcaaaaaacacaatgatgagggcatgtaaaagactgaaaagccaatctgaaagagcttccaatagctaaagctggaacaatttgaacaataaagtattacagtattggattataacccaacatataaaataaatatattcatggatccatcctgatagatagaaatgtctagataagtagagaaatggaggagaagagacaaatcatccatgtagagaattacaaatcatttatatacatactccctaactcccaccacaaagaggtggcacttaaatccccactccttgattgtaggttgcatttagtgacttgtttccagagagtagagtatgaaaaaggggaaacatacaactttatagtggagaaacctggcagttgctaccttggccaagtgatcaaggttaacatcatcagtgataagtcatgttgatagcatgtacccatgatacgatgtgatatgatgtgatgtgatatgattgatatgatatgatgagaatggttctttatctctgtggtctttctttactccccacaaacccataaccccattctaaccatgagaaaaacgtaagaaaagcccacatttaaggacatttttcagaataccgaaccaatactccacaaaactgtcaaggtcaccaataacaaggaaaatgtgagaaacttaaaaaccagaaaaggctaaggagacatgataattagttatattatggcattctagataggatcttggaatggaaaagtacgttaggaaaaataatgaaatccaaataaagtgtggagtttagtttattattagcaatataacaaggttggttccttaatgtagtgaatgtacatagtaatgtgagatattaataataggagaatatgggtgaagagtatacaggaactctttatactattttttgcaacttttctgtagatgtaaaactattctgaaatttttaaaaagttgttcaaataaaaaagttacagtatttttcaaatttggtaataccaaaagataagctatgtctcatatatgaatagttttgttttgcctctctggaagtattaataatgaagtctttcaaataaaaaagggcacttgggatatagagttgttcttcactatgtgggattgttccatccatggatctagcaatcattcagtaacctaatcattgtgataacccagtactactcataattctcaaaatgctcccaggaaacaatattggccctggcctggcatcaggatccctggccttaccacttttcttttttgtaaaccttatagttttccacgtgtgaacattttttaaattttatgaatacatattgttgtgatttgaaaaataattttattgaatgaatgttatactttgttttcattctactaaatttaatcttttatttgattagcattttttaccttttgctaatcaggaaatatgtttaagaaaaggagattaaatgtacatggataggatggagaccaccaaaagttagctccatcttctcattttaccttaatgctaaacaatttgcaattaaactctcagacagaagagtgtgctattctaaacattgttaacaaagcttgactcccagtgttccttctaattgtagtttctgtttcctgtaggcaatttgtgtgggaatgttaagcaaggcatgataatttttaagtaaataaatcttgtggtttataattgataatcagctgtatatataaatgtgtgtataaatatgcacacacatttacttagggcagatatttagttacctagggcagtatattagtctgttcttgcattactggcataaagacctacccgagactgggtaatttataatgaaaagaggtttaattggctcacagttccacaggctgtacaggaaacatggctggggaaacctcagaaaactttcaatcatggcggaaggtgaaggggaagcaggcacgtcttacatggctagagaaggaggaagagagcaaagggaaaggtgccacacactttgaaacaaccaggtctcatgagcactcactcactatcacgagaacagcaagggggaaatccacccccatgagccaatcacctcccaccagggccctcctccaacattggggattacaattcgacctgagttttgggtggggccacaaatccaaaccatatcattctgccccggcctctcccaaatctcatgtccttctcacattgcaaaatacaatcatcccttctcaacagcctgccaagtcttaacttatttcagcattaacttaaaagtctacagtccaaagtctcatctgagacaaggcaagtttcttccatctatgacactgtaaaatcaaaaccaagttaggtacctccaagatacaatggggttacaggcattgggtaaatacacccattccaaaagggagaaatcagccaaaagaaaggggctacaggaccatgcaattctgaaacccagcagggcggtcattaaatcttatagctccgtaattacctcccttgactccatgtctcacatccaggccacactgatgcaaggggtgggttcccaaggccatgggcagctctggccctgtgtctttgaagggtacaacccccttggtggctatcccaggctggcactgagtgcctacgtcttttccaggtacatggtgcaagctgttggtagatctgccattccgcagtctggaagatggtggtcctcttctcacagctccactaggcagtgccccagtggggactctgtgtgtgggccccacatttcccccccacattgccctagtagaggtcatccatgaggtctcctcccctgcagtagacttgtgcctggacatccatacatttccatagatcctctgaaatctaggcagaggctcccaagcctcaactcttaccctctatgcacccgcaggcttaacaacatgtggaagctgccaaggtttacagcttgtaccctctggatcagcagcctaaggtgtatctggggtccttttagccgcagctggagctggagtggctggggacacagaaagcagtgtcctgaggttgtacagggcagccaggctctgggcccagcctacaaaaaccattcttcccttctaggcctctgggcctctgacacgaggggctgctatgaaagtttctgaaatgcctttgaggccttttcctcattgtcttggctattaactttcagctcctctttacttatgcagatgtctacagctatcttgaattccttcccagaaaatgggtttttcttttgtaccagatagtcagactgcagatttctgaacttttatgctctgcttcccttttaaatataagttccagtttcataccatctctttggtcatgcatatgaccatacgctattagaagctaccaggccacttcttgaatgctttgctgcttagaaatttcttctgccagataccctaaatcatcactctgaagttcaaagttccacagatcccttgagcaggggcataatgctgccagtctccttggtaaagcattgcaagagtgacctttactgcagttcccaataatttcctcatttccatatgaggttacctcagcctggacttgactgtccatatcactatcagcattttggttacaatcattcaacaagtctctaagaagtccaaactttccctcatcttcctgtcttcttctgagccctccagactgttccaacctctgcccattaccaagttccaaaactgcatccacatttttaggtatctttatggcaatgccccactcctacataccaattttttgtgttagtccgttctcacgttgctagtaaagaactacctgagactgggtaatatataaggaaaagaggtttaattggctcacagttccacaggctgtacaggaagcattgctggggaggcctcgcgaaactttcaatcatggcagaaggcaaaggagaagcaggcatgccttacgtggttggagaaggaggaagagagcaaaggggaagatgccacatacttttaaacattcaggtcttgtgagtattcactcactatcacaagaacagcaagggggaaatctgcctccatgatgcagtcacctcccaccaggcccctcctccaacactggggattacagttcaacatgagatttgggtggggacagaaatccaaaccataccaagcagttttgctgaaatcgaatataactcaaagaccttttctgattgtttttaatcaaggaagtcaatgcttttcttcttgtcattaaatgtggtaccttattttcatcttataatgagtccgtgtagtgcatttagtagatgagtttgggttatgaggggttgtaatttaagacctcctctgttcacatctccaagaaattacattaagtttcaaaactttatacttgcccttaattcttgtgcctttctgattaagatcttccttgttttttagtttaatggtgtgaaaattctaaaaagctcagtctttggtaatcagtagataaagaaactgacagaaaacttaatgcattaacctgatacttcttttctttccacaaaaaattgaaatgttataattgtcacaatttcaacttacttgattctttgttattaatacctctctgtaaaaatgtgaagttctgttgacattgttgaggtgaatgtcttaaaagtgttgccctgatttgctgccaaatgtctttttctgatttatgctctgtgagtaccagcctagctatgcattaatgtgctctctgtgaaatgcttctgctttttgtacaaactattcttaagctatgctcacgggaatgaaggacaggttgttttatttcaataaggtaagaatgctttacatttaaagaaagcttcaaaaaacaacctgtgtcaattatacattaaatatcaggggtttgaaaccagttttgaatatgtgaccagaaaggatggtttgacttttcaaaagaatttccaatatcttaaaactttagaatttatctcgggttaggtgggcaatgtttagactaagttgtttcaatgctttccaataatacttttcataaaatttcacagatttagggtggctagctattgcagtaatacagtcttataataattaacgacagaatgttagaagcaaattgtgtgatttgcatgacttatgaaatgcagatggtgagaagtagacttggaagctttttcagggtgcagatggacacaagttcttcagtgaagttaattaaaagtaatcattgtatagtaaccactgtcttgtaggctgctaagaaattagtattctactttcccaaatgaaaatgccagatgatgcctttccaggctgtgggaaatatctttatcacctgtagtcatgtcaaaagacgcattcctcttcccctttcttcctccatctctagatttcatacagatgaataaaattaaagggacaaatactagtaggaagcactgtatatagaagacaatacaaattatctgtagtactaagttgggattggaggttgtggtccattccacatcctgtcctgtatttgtatgtgtgtttaattcatgtgtttacttctcaaaccctttattttaaaatggagataattaaaatgtgttttatagtgaatagctgaggaataattaatatatagtccaggcagaaatggaataacattctgacattggcaaaaaagaatttattactgtacaggatttaaaatgatcttaatggaaaagaattttttaagtattccagtttagaaataaattactagatatagctcacatgtgtttgccttatgatatggcatgaaaataagattatactgatttaaaaatgcatctgggttatagatttcaggtggctggctttgttttgggaactctttcccttttactaacttctgtcatgtagccacttctttttctaacagctgtattggagtgtttctcttcgagtcaatgtttttacttatttgagtcaaaagactacttaactaattttgcctagttattagaatggtatattccatttttcctgccagggaactcaatacaaaggtcctaaagcattgttgttgatgggtccaccaaacctggctaagtcctgaatcagtatagacctcatctcagtagtaaaccgtgtatatcacagtcccctagtacttctcagcattattttatcacaaagtttatgattatttaaattttatttctcaaatcttgtcagaagattggaatgtaagagttttattataaaaggtttattattatacatagtgatcaaaattattattaaacactgaatctgtgcaatgaaaatgataggtacttagcactagagctccatttaagtgacagaaatgtattgacttttcataggaaaaacaggcaattgtaagaaacaaatgaaccaattcgtttcagcttggatcactgaaaacaagagagaatcattggcaaaacaatgccttctcattcatgtgtcacaagtggtacttggattgaggacaattgagaagcattaagactgcaaattagttcccaagttgtgtagaatagttgtttgaaagtgtactttcccaaagctcctatgccagcttttaattttcttattaccagcagttttgtttttcttaggttttacattttggtctgcatttgtgttttccttataaaaatgctctatatatccaactagtacatcttgtgtaaatgatgtcaactcatatataagacttcattttgaggaattttaaaaatacacaaatttattaagagctttcttttaatccgtataatagtgtaacaatgttgaccttaaagcttttcagaaatattcaccatgattttgttattactacttcttcaatctttttgatattgacatgtttctaaacgacagtggatagtaagatgtcagattttatactttcattcaaactttgaagaccatttggattttttgggatgatcggctctgagccattcataactcatttgttaaaaacacataagtcttcgagtaaatgaatgccttgaaaaaaaaaagagatcatgtggttgagacagctttacttctgtcagggttacctatggtagggcaaattatttgggtttctggttttctttcctataaaagaaagttggatgatatgatcttaaaagctgtaagatttggtgattataagcttttaaattcatgttcatacttggtttataagtgatgaatgataaacattcttgattttctttacatctacttttatgaccaccagtgacagttgggccctctgaatttttcagtttaagtttttttctacccagtaattaaatgccaaacacgaaactgtatgtgctttacacaaagatttgctatgtaacaaaagtggaagatgtattttttatgttttaggtggatttgaatgcccacagatctaggccaccaatgccagtttacctttacagattctgtttggcaaattcctaagacattaggttacaaatctttctcctttctcttttttctttcttttttcctttttctatattctttcaccactgaaaacttttaacagttacaggttagcaagcatatcattgagcaaatgccctccagcctcttggagagtcttaactattcacactgtcttctctgcctgccccttggtaatatacaaaaagtttcaggtggctgaagccctaatatattaaaaacaaaaatttgaattctaaatacacctgtaagagcaaggaaaacataaattagaatatgtggtatatgtaaattgatatggagtatctgaaaaaaacagtactttttgttcttggtggtcatatttaaatcatacttttaaaatcaaaagtctgtgtaatatgatagttctgtaagttatatctagatgtctgtgaatgcatcaaacagatttttttaatgcatggagtacaagtacaacctttaagttcttagtgaaatttatgcctatttttatcaaactttaacatgtatggttttattatatttaatgggcaaatttgaagcacaaactcaaatacagttcttgtgtccgttattgaaacacatcatcatttaaaacagtttgtaacattttcttttataaaagaacatgctctatacactgacactcttgttctctgcacaatctatgagatgaattgatagctagaatgagaacaaacttttagaaatctcttggccctatgccctcatgttacttgtaagcatctgagctcggagaggttaaatgacttctctaaattcatgtatctttctagtagcaaaattagtatggcaaataactcagtatgaaagctcagaaatagtatgttgcatagatcttttcattgtgaggacatcctctattagaaacaagagaatgagttcttttgatcactggtgtcaaagttagaacacgtctttattaacacatgcaacaaacctacttcatagaataatcccctcattagaaatgtttgttttagatttcattttatcataactgaatgtaagattctgaaatgccaaaccccatttatagttaaaatgctattaactgctagaaaatcttctcctgatggtcttctaatctctgtgggctatgactcaatgattttaaatctcattttctaaagctttgcagattgttaacgcagtccagtgcaacaggattaaacacaaatctgaacacaccgtactttttgaggtccgtttagagctgaataagtggtttgctgtgctgaataatttattgtaattcactttaataattttccattttaattatgagcaatatacatgcacctaaaactcttaagtgtgaattttttgacactttaacccttagctgtctatattatttaagtaacctcattcacactactggaattaatatattagaataaattggtcccttgtgttttataatacaagtagctgtctatgatacaccaaaaaagtacatttgataccacatgttctcactcatatgtgggagctaaaaaaattgaatacatttaagtagtgagtagaattgtggttactagaggatgggaaggggagtggggatggggaattgggataggggtttgggagaggttggttaatggatacaaaattacagtcagatgggaggaataagttctagttttctgtagtactgtagggtaactatagttaacaataatttatgttttcaaatagctagaagagaggattttgaatggtcccaacacaaagaaatgataaacgtttaaggtgataaatatgctaattaccctgatttgatcattacattgtatacacatatcgaaatatcactctgtagcccataaatatgcacaattattacatgtcaatttaaaaagtgcattttgaaagatcaaggctgctgaattattttaaaatttattcagaaagcttattgattttgatgtcctccttttgtacctattgtatatattacttacttctatatagtagactttatatcatttaaactgttctgatttctgtctctttccaagattccgacatcctagtgttataaagcctcaacaattggaatctcaggttttacaaaaatatttgtttaaaatgagagtaattatagcagtgtgatatctgcatttatcagtgctttgataaggtgtgtacattgtatgcatcatagtgaaatttctggtaattattttaataactaaaagtatttaacaaaatggaaacaaatacattaatagatttttcaaatttaatatttatataggtctcttgtactatgtgtgctgtcaagtattcaataagtgaaaatataaaatactttttttcaccactataatgtcattgtatgatttttattctacatatttctctaatggtacttgctatcttttacaaactacttctgttgcatgttaatttttaggtattgtatttttcaagatttatcatcttttaaggaaggcaaaaacatgtaacttaatcacttgaaagtgaactgtgtcattatgcacattttctgatagctgctgtcaaagataaaataacacttcctgccaccataagaagtgtggtcacctcaggacagcactgagtcatacatctggggccagtaggaaaagttagcatcattggcagccgcctgggctcttcatgttccatggaaaatggcacactggcgcatagtgtaacttaaatatttctcaaatgcctaactccttggaaaaattaatgttaagtagtataaaaactgaaatctatgactttatattgaaccagcggttttgagttcttaatttaattatgcttgttccacccatttgtaattctgatttagtttaactaaatttaaattataacttgatatgttaaaatgaaagcaccttgtatagtaaagaacttaagaattgagtcgttactgtatttttttttttaatgcgttaaccactctcaacctaggtagcactggaatatgacccttaatgttttttcctgtctttgtaagatactgctgttaaaatttaacttagatctctgctggacttggaatctatatgtatatctaaagtatttatgcaattatacagaccagtaatacaatattagaaaacttggttgattacccttcataaataccagtagaatttggaagtacagaaactgcccacctccatccagtcaaataaataacctgaaagcataaacgctgtttagaagtgttttcttaatatgacttcaacatacttaaaataagtacctataaaaaacaaaatctttaatccaatggctactttctgagtatatattatcaggttataccttataggtattttttatatggaagtaacttgcatatccttcaaatgaaaggaaatttattttacagtcagtagtccctctatctttgtagtcttacttgaaacacatagtttactaattataacagtgctaattctgtatgtttgggtaatatttttatttgtatgtgagttagttttttaatagtaaaataaaacatgttgctacgtacttagatgttttaaaaattttctctaaacgtttaatccattataaaaacctcttaggatagtgcagttattcttttcattaggggatcagaataaccccattctaagttttgtcagaatctttaagtcacattaacttgtacttccaaagaataggcctgtcagggctgtctaccgtgactattgtataactaactaccaccagcatacatcgtcactacattacagtgtggaaaagtgtggcctttgaagccaaatacacctatatttaaatgccagctttgctatttattggctgtatgaattttggtatataataacctctttgagttattcaattttctcatttttaaaatgaagaaataacacctacctcaaagagtactgaggtttaaatgacgtagtctatgtaaaagatgtactaagtcactggcacttagtacattctagttcagtgttggctattattagtaccaccaccacctataaagaagagttgtagtcagggggtgataatatatgcaaagatcatagtagaagctaattattgttacaaccaggcatcatgccagtaacctgcaattaattaatactgtaattgaagttcaatgaaataatgtatttttgaggcattccaatttaatttcactgaaattacataacgaaattagagaaaaataaaagattaccgagaaaatgtatatagaaataaagagcccaagaatgggcagctgaactcaacatggcctgctcatacaaaaatttctgattgtagagtgctttgtcttaatatacttggatgccccattctgatcattaaaaaaagtcatacttctgaaatgtagaactccacataatttccatttggttatacatgatattttattaggacttagcagtatctgaatttctgaagactttaagaatagtatttggcacatgggcacaataaatatttctcaaatgaataaatgaaggaaatcaccctagttaataaaacttgatctcaggcaactgctactactcttaaacttttgtgtcatatgtaaatttaggggcacggccagaaatattgtaggtctccttttttttcctcttcctccttttcaagacctaagaaagatacattttatttaagatcagatatttcctttttatatgtttgtatagattaaacatttctattgaaaactgttctatgaacaaaaagttcataggttgttgcctgaatgaaaaaccaaatcaaaatatatagagaaaatatttttcaatgaataaaatgccttaattctttttggacaaacttgcctaaatttagaggtttcattatgtgtgggctgaaagggcagatgaaagatcacattttaaaattttatgtttcaatgactcctttctttcttacttccttacaagtgttttgcagtgctagaagtatgcaagtagagttttaaaagattttagtcctttttagctttgaagtccaggaatttaaactataccttgttcaagcttgttccttttggccaagatatatctttgctgaacaatgatttgttaaaataggatttctattataagccaggatgtcagcaatactaatagtattagaatgaatgagcttagaaaactgggttaagaaatgatcaggaagaaagtaaggaggttggatagtccactataaataatattaaaatagctgaaaattttctgtaagggtagatagcaaccttttgactttttaatgttatgtggttaaaaaaaatcgtgtattttaaaattggaaataatatgggtttgtatttcttgatcattatctaaatctacaaacatttaaccaaaatggtgatggcatgagctacaaagatctggctctaaaataatttattttggcctttttcaaaaccgaacaaatatcacttctgggttcgtggcacatcatttttcaatggcccatttttcccctttcctttcataattatgtagccctggagtgagagtaggtatgtgtatacatgtgcacctatgtgcctatttcagtagtgtactaagtcctgtctagagtagagaaacctatataacatacagcaatccctatcttttggttaatttcattttaagaatcggtcagagcaaacattttcttttttaccacctttgtttttagatcactgcacagctcattctggaaggaacaaagaaacagaaatagcatagtctttgatcctgggaaacttctaatgtacaataaatgtaaaactagatatttgtacaaacagtaaccattcatgctgtgcctattaagtgtcagccacttttcatactgacttgatttggacattgcagcagcatctctaggttagatgttattaaccaattttaaagatgaaacagattaaaaggacttactagtaaatgacagattcaaaactcagaacccagggtcctctgaatcaatagaccatgcattttctctcaaacatatggtctctcaaattaaataagaacacctacccaatagtgacccttatttttctctagttcatcttacctgagttcaaagaagtgcttttctactgatcaaaaaaggataaaaacagggttgccacatccatacatggttgtgtaggttagcagtacataacctgcacaactctatattgtgtcattggataagtaaggacatagagttgcaaacctagggcaagtaaaaggaatctttataacacccctatttttgtttattcaatagaatttggaaaattagaataaattaatatttttaaatgatttttaaattttcatatttaggtaatgcaaatgtttatgctgaagactatatttgaagttatgaacaacttaggtttaatattttaaaacagtatgtttgtatgattttttcatttttaatctagcaactaatatgaaattttagtggcaaatgagcacatagattatattacaacattttacaaataaaaatacatttttagtatcttagaacgtgaaactagttgacatttaattagctcctatttatgctaaaagagaggataatgctaaaatagtaaataaatatttttatatttatttgacataattttttgtgcctggtttaccgtcttaattatgtttaggacataattcttaaattgatctgttgaatccttaagctcatgattgaggcaaacctattaacaagttcatcaaacctgtgaacaggaagagccaggaaaacactgaaaaactataagggaagattaactttaccagacattaaaatattataaaacctctatcataaaaacagtatggtgctggcccatgcatagacagatataccagtggaatagaatagaaagcctagaactagatcctggcacatatagaaatttactatatgataaaggttgcatctcagatcattggggaaaagatgtttgtccattgccatttggaaagagagacagttaaataccttgcagcttacacaagaatagcctccaagtggattaggtatctaagtgtaaaaattgaagccacaaaagtactaaaaaacccaagatttttacattggtatgtatttctagggaaaatttcacatacaataggaaaattttcttctaacatggcagactctcccccacctcattttgcagatgtgattatttgcaggtaacaggcataggggaaatcagttctccctcagtattcacaatcttgtcaccagctacatgtattctctttaaaacatcactggcaaaattataaatttatgctgttattaccttttaagagtagactcactcctaattaccatgatttgtttatatacattaacaaacagttctaccctaaattttatcatacgaactttagtgtcaattagtctaacttcataaaatatcaaaggtaactccgatttcatgacggtgagatatggaaagtatgttaaattctactgtgactatgactgatgatcgtaaagtttagttatagagagaaaagagttaattggtgattcttcactaaatgtaagtttcagaaggaaaagatcttacataaaatttatagaaacccacaaaagttaactttaaatctatattgaattttaaaataaagcagaaaggatgctcattatgccagcatgtattaaataccttctgtgaactaggttctattctgataatacaaaaatggcatttagtcccatagctggtcttactattaataagtatctgataattaaatgcagaatcttaccctaaataagggttattgactccaatgtgtaagtttctgttctttatacagctgctatgttatatttcatgtataccacatgctacttggcagaacaaagggtaaactacagtacattttaagtaactacttccaaaaaatagcattgtatagcaaacagttccacatgggatctttcattgcagcttctattttcataaatagaaacatgcagcaatatgtagctaagtaaacaaaattgcaagaatagcttaattagttgaaagatccagtgtacctaatcacttacctttcatagaatttgctttgaagaaaaaaaatagcctattctgggatccatagaggagagatgcaagatgcttctataagaaacagtggctcactaaagcctaacttcttaaggagtaaagcaggagaaagggggatgatgagattttatcagaagctagggtttatgtgtgtacagtttttaaaaagtcccctaagtgtcttttaacaggacgatatttaaaatttaatgttctgtctgtcattttttcccttttgtggctactcgttgtatcttgcttgggaagacattttccatccctatattatataaatcttttcctgtatattgtcccaatatattcatttcttaaaacctttagttagctttttattatgtaatttaaaaaaatgtgcagtatattctggccaggcatggtggctcacacctgtaaccctagcactttgggaggctgaggcgggcggatcatttgaagtcaggagtttgagaccagcctggccaaaatggtgaaaccctgtctctactgaaaatacaaaaactagtcgggcatggtgatgcgtgtctgtaatcccagctgcttgggaggctgaggcaggagaatctccttaagccgggagtcagaggttggagtgagccaagagtgtgccactgtactccagcctgggaaacaagagcaaaactctgtctcaaaaaaaaaaaaaaaaaaaaaaagtacaatataaagtagaggatctgacattacttttttcccagatggagagccaggcgttctaacacaacttatggggtaattttcccctcacttatttgaaatgctaactttataaaaaatcaaaatgataaacctcaattatgtaaactaaaatacaaatgcataggtctgtttctggattcttcctttttggatatatttatccattttctatttcattggaattttgaattattgttactttatagaatgtttgctatctgaatggcaagtttcctcacccccatgttttactttttcaaatatttcttgattactgcccatttttcctttcatgtggaatttaggttcagtttgtcaaggctcacacaaaaataatctcattaggatcttgactaggatttcattgaatttataggttaatttagagaaaattaatatccatatactattgggcattcttatccaggaatgtgctatactttcttacttatttggatcttcttttatatccttcagtggaatttgatagctttttaaaaaataaatgtcatctacatttctctttaggtttattcctagtttattggttttttacctattgtgaatagaatttttttcattacattttctaattggctttgctgagtatggggaagttattgaatactgctcttgtatttgactaccttaataaacttgcttattgttctgtgtttttcagttgattttcttggtaaattttctttggttgattttcttggtatttctaagtaaataatattatgcatatgttgatagttttttatcatctaatatccataattctttttcttccctgtctgcgtttgctaggaccactgctcaatgttgaatattcttgatctttagttagtaagaatgctgcttgagtttcactattatattgattatgatgattttgaattgttctaaatgtgctctgcatttgacaaggtctggttaattgatatattaactttcaaatttgtaattaagttttataattaaaaataaatatatttatataaaatcctaacggttcagaaaagttagttttaggaaatgatcattcatgattcctgaggcttaagggtttagcttgctgtgtagattctacatagcagagtagcgtgtagattctacatagcagagtagcatatagactctacagagcaggcccagggtccccagcccttgggctatgaaactgtactggttcatggcctgttaggaaaatgggcggcacagcaggaggtgtgtggctgatgaacgagcactacagtctgagttctgcctcctatcagatgaccggtgccattttagattctcataggaatgcacactgtgttgtgcactgagcatgtgagggatctaggttgtgcacttcttatgagaatataatgcctgatgatctgaggtggaacagtttcatcctgaaaccatccccccattgcccacagaaaaagtatcttccacaaagccggtccctggggccaaaaaggttggggactactgatgtagaggatgagttttcatcttttatttgaacttggtgacttagtttaccaagtaacttgctttcagatcttgtaataaaaatgtagttttagccataaaacatctaattctgttttgagctggtagcagtttatatatatatgtactgatgatatgattaacatttttattgaactgctcaggagtctaactatgtatctccattatttagaaattttctgaaaactgtttcatgcattcctttggaaattcataaagtaagcttctgagaataaagaaattgagagatatgaccactggaccactcctagctgggccaaaaagtattccataaagtttatgatctcccctctccattcctttctgtcaagatcagaagaggtaggagtaggggagtcaatatcatgtctctttagtttgtagaaatcatgatttgaaatacaagtttgtaattttcttgaggtcttctgaatattaatcctgttgccaaatcacagatcactttccctgtacatatttaaaggaaatatttttatttcgttagctaatgtaagtcctgttttttaaaaaacgaaagttgttctttatgctgtcttctttttttcttaacaattaaaccatgaaacaaccataagttgaaaagtttcattgattctgctcctcattgtaacagttggtgatttggtggcattagtaggtcatagtcatagagtaacagtactcttctccaatttgacagactaggttaaggcttttggttttggaatatagattagaactatattatttctaaaataaatcttaatgctgtaagatgtttggaagcaaatataaaactgtagttaatgttgcactcaggaattattagaaggttgaagtgaaggacaaaagaaataaattttattacagaaaacatgtctcctaattaagtattcattaactgcccaaagttgaacttgttaacctcaaggttggaatatactctatgtgttggagaatagatgccatagtagaacctttggtagttaagacagatgtacctgggctatatttcttccagagaatactagtttctcaagatcagctattctgtttcctatgctatgctttttattattctctagtttctttttctttttctattgtgttctcacaagattatcaagaacccctcaccccctcctattcaagcagaaattttggttgtttttccctccttcttggcaagatttgggattgtcatgaaaagtaatgaaatcagctcttttatatataaaattttccatggatgacatgactcagttttgaatagaaatgcaaggttccattttgaattctttaccttttttggattatagcactgctaggtcaagatcagagcgctttgttcataagtaaagtgtataaaacgtaacaggaacttaaagtttcctttatcattattgaatgaatcacacacttcttaaatttttaatctgtggtgctataaccaaaagaacatgtttcctgggaggctgctgacaataaaaagtaattgtagattttcttatgttgttacatattttagtatatttcttattttcttttttaaaataaaaagttcttattcactctaggatccttagaaattttttccatttctagaaaaatatcttgaattcagtagcctgctgtttaaagttatcatgagtagtgaactgttgcctttgggaaaggagcattttgatccaactatgcattttaaatagaaagataatattcatctttcccatatacattaatttagaaatgtctaccaatattttctatacctttcacaatgattatttgcaattcttatcaacattagcttttactttttatatttataatatttgcaatatatagtgcaggaaattcccattaacctgtggctactcaggatgactctcactgagttgttggtttctttcacaggttgatttacagctgtcttgagtataattctgtgtagcaggcaatggtagtgtatttatatgtatacagatcttgcatccatcaggttcttctcattgaaacacaccagcggagagcttactaaaagattgtttgcacagctgctttcaggcagtgaccaaaatttcctaggaaagtgagtgaaaatacacttgttgagccaagctcagaagtttcttggatagtgctttacataatataaagtcattacatgtgttggatctttgcccttatctaacctcccccaacctccactccactccactccacgttcttttttgtcttgcttagtctcctttccctaggagaagagcttttgtttacccttttatgtcttgtgaagtcactaaaaaagatttgtcttctcatatgacatcagtatctaaggaccttcaattacatatcatgttagtttttttttaattctgagacctaagtgaagatgatgtccatatatttttgtcctcttatagactcctatctatgaaactaggtttttcagcagtaatgtaatcacaggagaatcgtaagaacattaagctcctttaactgttgggttgccaacaatatgaatgtggtgttaaatcatgtcttggactttacaaatatcatctaaaagttagttcttaaattcctggcaaggaatttacactgtgctaagaaacagatgttatggagattaatttgtgactggagaagaaatgtctctgtggtaagagatgagtacaggttctgggcaatccatttgacttttaaatgtaagaatggaattccaaacacttaacacattcagctatatgacagaaagtaaatctatggatatggtattttgtgaatgatcttttaaataaaagaaaaccttacataaaaaatgaaaaaattatatatatatatatatatatatatatatatatatatatatatatatatatgtctgtcagactgtttcttagtcacagtattagtcaaggtttgctatccactctccccaccatcctgattcaaatgcatctgcagaagtttttgctccttcctttctgagtttcaggtatttcttctgattcctatccacttgtaaaatttggagtctagagggaaccaagggaaagcagtgattacaactgacatcttccagtttgattggtgaaaggagaaacctcacttccttaatgaacattgatcatagtaaaatgctgtcataactcaggagaattttgctaagcagagaggaattacaaaaaatattagaatacatattttcagagttctttgagaaatatttgataaggaacatgaacttgtttgtggtttcttttttgatagagcttctgcaacattcttttagaattaataacagtattgtgaaggttgaggctaatttttcgtttagcctggtgaatttctccacaggcttcacttttgggaaaataaggaagttctctaagtatccataaaacatgaaattagggatttattcaaataaacataattaaaattattttggaatagactttttctctccatttagttgtaataatttgtctagcttacagttcctttgttgtctatagatgtctgagaaatatttgttaattcttgggtatcattatatattttctaattggggctggcaattacaaaaacggcatagctaaataatctagaaacataagcctaattgtgtctgtgtgtgtgtgtgtgtgtgtgtgtgtgtgtgtataaccaattatcattattgtcctatttgatgacttcatcacttattgaaaaaaatcaagtctctttttgcctttgacaagtgttgctctagtaatgtgaatattttggagcttgttagaaatacaaaatctcaggccacactccaactaaatcaaaatttactacagtttaatcagatccccagatgttttatatgcacataaaatttaagaagcaatggaaaactgacattgttttgagtagtaattagaaatttgtaattaatttataattttaaaataaaattggaattattttgagaaagtcttataaattttaggagaataaaacagggccttcaaaataggctgttttcctgggttaagtaaaatttacttcataggtgaaaagaaattatttggcttttaatttcattatgctatgttacaaattgattctgatatataaagcaaaacaaaaaattgagtatcaccacttatattatttttaggaaacatgatcagaaatggctgttgtacgaatgtaggattctttttatcctaacattaaatccttacttgtgataagatactaacattcatagctttattttaactttaatattcaataaaagtaatgatagtttagtgattagatggagagtacatgttgactaagtatttcagttagcctagtattttagaacacgttttaagagtcaaaaaattctaaagcaccaaaggattgtgtgtgtgtgtgtgtgtgtgtgtgtttgactctgtaaacttattgagtagttaataatgctgacattcatttatagtgggcaaatgtgtgtttgtgtgtgtgtgtttgtgtgtgtgtgtgtgtggatttgaaatgatgaataagatttgttttgtattagggaaggatcacaggggatatatttagattaagtttaatagtagatggtgccctttgtttctgcagtacttttatactaaacttttcttttgtggagattatttcagtcatatttaataagatgcatatgtctgaattaatatgatcggctgtaacttctaatggcagtttttttacctctatattactatacagttttttctggaattaccacttttgaaggtaatttaccttttaccacatttttctgttgattttgaattctttttcaggagacaatggatatagttctaaataatgtatgaaataagttctacttgtagatcttttccttaacttcccttactaagaggagagtaagaggaattttagataggcgtagaggaataaaatggccaaagaaagatcatgtgtagaaaagcttcaacttgcatagctaaaatagcgaaccaagtggagatgccaagcacgaagattacaaccaaagatgatcctttctgcggcaaaaggcaaactggccacaagtcactgttctacacgttgaaaccagagaagagtttttcagaacgtgagtctgaacacagccttcagtcatggtggccttctttcagtgcctcatactctcactcctgtctccaagctgctgagtccttgctgttttcagggtctaatactctttcctccctctttggctagttaactcccagtcatctctagacctcagttcttgccacacttctcccagaaaacttactcctgatctctctgacatggtcaaatcaccatattatgggctcctggagcaccatgccaggtacctttactttccttcaattacttgttagggttgtttgtgtgattacttacttaacatgattctctctcaataaactattacctcagtgaaagcaggggccatgtccgtttctgctcacttttcttctttactccctagaataatgcctggctcaaaaataggcattcaacaaatatttgttcaattaataaataaaagttggtatcaggaattagaaaagcagtgagatgagcatcctgatactagggacaggaagggaagcattccttaggaaaatcatatagaagtctgtgttgtagaagaataaagaacaggcagttattgactttggaacctagtttaaatctaaaaatatcaggagcattagggaagcctgggactgagataagccaagattagacgtgtcctcagaagtaaagttggatcaacaagtttgccctttacaatggcaagtctccagcattgttctcattaccacttcctcttacctcccacctggaagactgtctcctcttgcccgtgggcaagtcctccttggagaagatagtttctcctggcaccttggcaaagatgactgactaattcttcatgacacgaattactttaaaattcatctagatgtcatttagatacaaaattcttttttcccttgatatttctagtgtacaattttcagcatgtcctcactcaatattgcttagatattaaatggaaatatttaaaaagatagccgtgttaagtcccatcatgattaggcaattttttcatggtgaattaggattgggtaagacatcatactgatgacttctatgtagaatatgctaaatttagcaaatcattgccactagtggtttctttgtattcaatagaaaagaaaattgtatatctattagtgaagtttgattacacataggtggacatagcattcgtaatcagatgtaaaatagtaacttacagctgtggctttcacatacccatatgcctcccaaaatgcttaggtctaattaaaatttgaaaggagcaaatttaggctatttaaggttaatctgttggttaatttgtacttcttattatagtaaaatatagataacataaaatttgccattttaaccattgcatttttaagtgtaaaatgcacatatcatcaaacgtactatcttaaccatctttaagtgtacagttcactggcattaagtacattcacatttttgtgctactgacctcagcatccattcacagaattcttttcatcttgcaaaactgaaactctttactcattaaacaacaatccctattattcctcccctcagcctctggcagccccattctactttctgtctctgaatttgacgactgcatgacgactgcatgcctcatataagtggaatcatacagtatctgtccttttgtgaatggcttatttcacttagcataatgtcttcagggttgatccatgcagtaccatgtatcagcactttctttttaaggctgaataaaaatgtatacacattttaaaatgtgtatacaacatttaaaaaatatttttaatttttatgggtacatagtaggtgtgtatatatggggtacatgagatgttttgatacaggcatgcaatgtgaaataatcacatcatggagaatggggtatccatcctctcaagcatttatcctttgtgttacaaacaatataactatattattttagttatattaaaatgtacaattaaattattcactatagtcagtcgactgagtgactctactatttgctgtcaaaaagaatgaacttattcattctttctaaatatatttttgtaagtattaaccttctccaccttcccctcacctccccacaccactagccttccctccctttggtaaccatccttctactctgtttaatttttagatcccacaaataagtgagaacatttgatatttgtctttctgtgcctagcttatttcacttgacataatgatctccagttccaaccatgtcgttgcaaatgacaggatctcattcttttttatggctgaatattactccattgtgtatatgtaccacattttctttattcacctgttgatggacacaagttgcttcaagatcttggctattgtgaacagaactgcaacaaactgcagaactgcaacaaatccctatcaaaataccaatgacattcttcacagaaatagaaaaaaaaaatcctaaaatgcatatggaaccacgaaagacccagaatagccactgggtcttctgggacccagtgcagatatcttactgatatcctgatttcctttctttggggtgtatacccagcagtaggattgctggatcatgtggcagctctgtttttagttttttgaggaaccactaaactattctccatagtggttgtactaatttacattcccaccaacagtatacgagggttgccttttctccacatcctcaccaggatttgttactgcttgtcttttggatataagccattttaactggggtgagatgctatctcattgtagtttttctttgcatttctgtgatggtcagtgacgctgcataccttttcatataccttatggccgtttgtatgtcttttgagaactgcctattcaaatcttttgcccatttttaaccagattattagatttttttttttcctatggagttgtttgagctccttacatattctggttgttaatcccttgtcaggtgggtagcttgcaaatatgttctcccattttgtgggttgtctcttcactttgttgactgtttcctttgctgtgcagaagcaaaggaccccatttgttcatttttgctttggttgcctgtgattgtggggtattactcaagaaatctttgccaagaccagtgtcctggagagcttctgcaatgttttctggtagtagtttcatagtttgaggtctttaagtctttaatcaattttgaattttgtatatagcaggagatacagatctagtttctttcttctgcccatggatatccagttttcccataaccatttattaaagagactggccttctccagtgtatgtccttggcacttttgtcgaaaatgagtgcactgtgggtgtgtggatttttttctgtgtactctgttctgttccactggtctctgtgtctctttttatgccagcaccatgctgtcttgtttactatacctcagtagtataatttgaagtcagttctgtgattcctccagttgtgttctttttgcttaggatagctttggctattctgggtcttttgtgattccatatacattttaggatggtcttttttctatttctgtgaagaatgtcattggtattttgatagggattgcattgaatctgtagattgctttgagtaatatggacattttaaaaaatattcattcttccaatccatgaacatgaaatatctttccattttttggtggtttcttccatttcttgcatcagtgttttatagttttcattgtagagatctttcacttctttggttaagttgattcctaggtgtttaactttatgtggggctattataaattaaattactttattttctctttcaggttgttgactgttggcatgtagaaatgctactgatttttgtgtgttaattttgtatcctgtaactttactgaatttatcacttctaatagttcttttgtggattctttaggtttttctaaatataagatcatctcatcagcaaataagaataatttgacttctcattgttcaattcccacctatgagtgagaacatgcggtgtttggttttttgtccttgtgatagtttgctgagaatgatggtttccgaacacaggaaggggaacatcacacaccagggcctgttgtggggtggggggaggggggagggatagcattaggagatatacctaatgtaaatgacgagttaatgggtgcagcacaccaacatggcacatgtatacatatgtaacaaacctgcacgttgtgcacatgtaccctagaacttaaagtattatatatatatgatatgtatatacatatatacaatacatatatacatatatacacacacacacacacacacacacacacacacacacacatatatatatatatatgaagaataatttgacttcttcctttccaatttggatgccatttatttatttctcttgcctggctgctctagctaggacttccagtactatgttgaataacagtggtggcagtgggcatctttgtcgtgttccagatcttgaaggaaaggctttcagtttttccctattcattatgatactagctgtgggactgccatatatggcatttattatgttaaggtatgttccttctatactcagttttttgggggtttttatcatgaagtgatgttgaattttattaaatgctttttcagcatcaaatgaaatgatcagatggtttttgttcgttattctgtagatacgatgtaccacattgattgatttgcatatgttgaacaagtcttgcatcccagggataaatacttggtcatgatgaatgatcgttttaaagtaatattactgtattcagttgctagtattttgttgaggttttttgcatcaatattcatcagatatattggcctgtagttttcttttttcaatgtgtctttggttttggtatcagggtaatacttgcctcatgtaatgagtttggcagtattctcttctatttttcagaatagtttgggtcagattggtattagttctcctttaaatatttggtagagttcacctgtgaagccattagctcccaggcttttctttactgtgagactttttattatggcttcaatctccttacttgttattggcctattcaagttttggatttctttatggttcaatcttggtaggttgtttttgtctagaaatttgctcatttcttcaagattttccagtttatcagcatgtagtttctcatagtagccactaatgatcctttgaatttctgcagtatcaagtgtaatgtgtccgtttttacctctgattttatttatttgggtcgtctttcttattttcttagtctagccaaaggtttgtcaactttaacttttcaaaatgcgaattttttgttttattgctcttttgtgttgcttcatttcaatttcatttgtctatggtcttatctttattatctcttccagtattttggttttggtttgctctcttttctagctctttaagatgcattgttaggttgtttatttgaagtttttcttcttttttgaggtaagcacatataactataaatttccctcttagtactgcttttgctatatcccataggtttttgtatgttgtgttttcattatcatttgtttcaagaaagttttcaatttccttcctaatttcttcattgatccacttgtcatttggaaatgtattgttcaattttcatgtattcgtgtagtttccaaaattcctcttgtcatcaatttctagttttattcttttgtagtcagagaagatgcttgagaggattttagtttttttgaatgttttaaggcttgttttgtaacctaacatggtctgtctttgagaatgatccatttgctgaggaaaagaatgcgtattctgcagtctttggatgaaatattctatacatgtctgttaggtccatttgttctatagtgtagataaactccaacgtttcttggttaatttctgtctggaatatctgtcaaatgctgaaagtggggtgttgaagtctccagctattattatattgggggttctctctctctttagcttcatttgatatttgctttatatatttgagttctccagtgctgtttgcatatatatttgaaattctcttgttgaattggcccctttatcattctattattttgcctctttttatagattttgtcttgaaatctatttttcctgatatgagtatagctactcctgctctttttgggtttccattggcttggaatatcttttccattcctttactttcagtctatgtgtgtctttataggtgaagtttcttataggcaacaaatcactgtgttttgttttgttttgtttttaaatttatgcagccactctatgactttttattggagagtttagtccatttgtattcagtgttactgttgataagtaaagacttcctcctgccattttgttatttgttttctggttgttttatggtctcttccttctttctttctttctgttctatcttccttttagtgaaagtgattttctctgttgaaatgatttagtttcttggtttgaggttcccatgagccttgcaaatactatcttaataaccattattttaagctgatgagaacttaacactgtttgcactaacaaacaaacaagcaaaaagaaaagtaataaaaactctatgcctcaacttcatactcccactatttaactttttgttgtttctatttagatcttattgtactgtctatgtcttgaaaagctgttgtagttattatttttgattggttcattgtttagtctttctgcttaggataaaaggaatttacacgccacaattacagtgttggtataatattctgtgttttttttgtgtggttactattgccagtaagttttttacctttagatgactagttattgctcataaatgtccttttctttctgattgaagtacttcctttagcatttcttgcaggacaggtctcatgttgaggaaattccacagcttttgtttggaaaagtctttatttctccctcatgtttgaagaatatttttgctgtttatactcttctagggtaaaagttttttccttcatcactttaaatatgtcatgccactctctgctggcctataagttttccaccgaaaactctgtcatcagatctattggagctccattgtatgttgtttgtttgtgttctcttgttgctttgaggatcctttatccttgacttttggacttgaggtagtcaaggcatttaataatccctgttaaaagactctgatgcatttttcagtatgacaattgtgtttttcagctccagtatttctgcttgattcttttaaattatttcaatctctttgttaaatttatctaatattgtctttgggttaaatctgcttgctgttctataaccttcttgtacttaggtatcgatgtatttctctaggtttgggaagttctctgttattattcctttcaataaaccttctacccctgactttttcctctacctcctgattaagggcaataactcttatatattcccttttgaggtgcctgtaggcatggttaattgttttttattcttgttttaatctcttctgactgtgcattttcaaatagccagtcttcaagctcacgaattctttgttctgcttgaccaaatctgctgttaaaagactctgatgcatttttcagtatgacaattgcatttttcagctccagtatttctgcttgattcttttagattatttcaatctctttgttaaatttatctgatagaattctgaattccttctctgtgttatcttgaaatttctttaagtttcctcaaaatagctattttgaattctctacctgaaatgtcacatatcttttgtttttccaggattggtacctggtgccttatttcgttcatttgatgaggttatgttttcctgaattgtcctaatacttgtagatgtttatctgttgctgggcattgaaaagttaggaatttattagagtttttgcagccaagacttgtttgtacccatccttcttgggaaggcattccagatattcaaaaggacttaggtgttatgatctaagctgtatctgcctcagggagcaccccaagcccggtgatgctgtgcttcttacagactcatagaggcctccttgatgatcttggacaagatctgggataattctctggattacctggcagagacttttgttctcttcccttactgtctcccaaataaacagtctctcactctgttgtgagccacctgaagctgtgggtggagtgagacaagcacccttgtggccaccaccaccatgactgtgctgggtcatacctgaagccaacacagcactacatcttgctcaagtcctgctttaacccctccctggctactgcttatgttctctcaagaccctgaggctctacagtcagcaaatgccaaagccagtgggcttgtgttcttcccttcagggcagcaatttcccccaggccctgggtgggtccagaggtgctgtctgggagccagggactagcatttaaaaccttagaagtgcacctggtgttctgttgtactgtggctgatctgacactcaaaccacaagatgtagttcttcccactcttctctcccctttccaaaggcagaggatccccaccccatggccactgtcaccacaaaaccatggtaagtagtgccaaactaccactgctgtttccttaaggcctgaggtctcttcaatcagcttgtagcgaatgctgcctggcctgggcctcacccttcaaggacagtgggctcccctctggcccagggcaggtccagaaatgccatccatccaagagccaagtcctagaattgtggaccccaagaacctgctttgttctctagccccctatgcatgagctggtacctaaggtacaagacaaagtcccctttcctttttcttctgcttttttgaagcagaaggaattgtgccccgtagtcaaccgcagctccagatgtgctgggtctcacctgaagccaacaagtctcacagtctcacacagggcccttgatttagtacttgggtatcattgctgctttttcagggcccaagggctcttcagttagctggtgatgaatggtgccaggatggggtcattcccttctggaccagggtatgtctaggaatgtcatccaggagcttgggcctggaaaggggccctcatgactctgaccagtgccctatcctgccatggctaagctagtatccaagatgcaagataaagttttccctgttttctcctcaagcggaaggaaggagtctcttttggagccatgagctgtaaagcctggggttagggaagagataataccagcactctcttggccaccctggctggtgttttagtatgttgtgtgtcacccctatccactgtctctgggccctgttcagcattagaactctcctaggatttgcagtccttgtggcctagactgtgtttcaagtttatttatttaaatcctcatagcactttagcccatggtgtccaggtttgtgggaactcaggttccaactgccaggattgatgattccgctctggctagggctggtttaaatgctccctctgtgggtgggcatcagctgagtttggtcttgttttcctttctgctctatcaggacagcagcaagttcaatgcctcacaattgctgtgctctccctccagcacaaagaaacactctagtcaccacgctaccactgcctgggcttcaggaaggtgtggcatcactgatttaagatggtttttttttttttttttttaaggttttcagtgcctttttcagtgatgcgaagttaaaactgggtactgtgagtgctcacctgatgtttggttcctatgagggtgcttttttgtgtagataattattaaattggtgtccttgcggggggctagggaaggcaattggtggagccttctgttctaccatcttgctccacctcctccaacattttctttatctacttatacatcagtggacacttgggttgcttccacctctcgcctattgtgaataatgcttttatgaacataggtgtacaactatctcttcaaatatctgctttcattttgtttgggtatgtagcctgaagtggaattgctgaattctatggtaatcttttttttattttatatttatttttttctttgttttttggagagtagttttattagcttgggatataatgggatcatcactaggagggcagggtattccactggttaccacgtgcagctgtctggggagcatgataaaattcagtccagggttctgtgctggggagcagggccttgaaaagaaggcaaattgtccagggaagtagtagctgtgagggtcatggctaccttgctccactctactgcactggatctcctggtgcttttcaggctcctgtcaatcctgcatctgtatggggcaatggaccatctggcccaaaacttcatcctcaagtttgatgtaggccaggcatttctgcttctttccactggacttgactttgcactcaggattcttcttgcagaaatttatatactggagcttaaattctagccccacaaagttccctgctggggagagtgtatccatagcactgctcatattggtctccctgaaggctcactgcataagtggatgcttatggaatttccccagggtacctgcaggccctgctgctaggcctttaggagctcagccccgcctaatcccatggtgcccagccataggtccagcaggatcagcagctactgcatgggtttccctcagtcaccctggaccttctttcctgtgccttcaagaaatttcctaaccttcaccatggctaaatcttggcctcagctgtcaatctcttcctggtcttctccccctgcacatccctgcccctgatgctctttcctactgtgggggcctgttttcacttatgtacttattttctccctggaattataaaccctgttgatagactgtaacatccttaaagtcagcaaagataaacatgtttctatcttcatgataaccagttattatttggtctacaatacaatgtaatttttttaaatgtattttcagccttgctgtaagaaacagtctaatgggaacttatagttgtgtttatcaaaagagtttattgaaggtgttgtttattacattacacaaggatttcttcccacaagaaatcctttttgctgactttagtgtcaaaaatggatgggcatgtttgaggtgatggatattccaattaccctgtttttatcattatactttgtataatgtatcagaatatcacatgtatctcataagtatatacagttattatgtatcaatttaagaaaagactggatgggcttctccgagaaactggcttgctgttatctaatgaatgttttaaactattaatgtttttcatttgtatgaattttttatattttcattattctggctcccactttatgactaaccatattttcctcatctactttgaatttgtattgccctcctgaattgtgtgtgtgtaaacaatatacttaaatgccttttgatgcaaagcataatttaaataaatatatattaaacaaagaccttaaagttttaatggaaaatagaaaaacatttttggtataatgacttttggtatggtacaaacaaacagtctagaggtttggaaaccatcctttccgttcctccctcactcctaattctgcatagtctttaagagcatggatttagaggcaaatggacttgggtttagaccttgccttaccatttataagctgttggatcccaggcatggtccctaaatttaaattttcttatctgtaaaatcaagataatgatatacagttcataaataatagaaggtattactattattcagcatcaattcttctatatagaattgatataaaactattgaaagtgtagcctttttcaaaataagttaggacagagtaaatgagaacagtcccagaagaaaattatccttccttttaaaattttatttggttttcttgagaatccttgtgaaaacaaatcatatgctacttgttatagagcgactgcttgcttgtaggaggacgactgttaaggatgcctttgaagaacataaagaacaggggtttctcaggtcaacatgtattatattggtatctaaaaactatttgcaatgtttcccctttcattcattcaaatgccacttcagattgaatgccatctgggtactctacacagtattgaattcatcaagagtatgctagcatggactttagtccttggtagttttaattttttttttctggtaggtctagaagagtgtgatttcattagccactgttgtatgttattctttttcattttaataactgtatgtttctatctctctttacccatttatttttgcaagggtatgaatccactttattgttgagatgtgttttttcagtcttgagatggtccgatatagtcgaattaggtttgattttggatcctctgggaccaggttttaattattggtttgcctgtgagttacttactgtgtacacttagagaattacctaatctcactgagctttaatttcttcacttctgaaattggtataacagcagtctctttgacacgacttggcatctttctgtttacttcccatcctcaccattatcctgtaatcttctaaaggaatattctacatgcaaggccttcactttctcatttcccagtcactgctcaatcccgtagtctgtctggcttctctttgccttattctaatactgttctggctaaaatcattgataatctcttaattctcagagtgctttagtccttatcttactagaatgctgtgttgcatttaacacttgtctgtcgtgcctttcttattattaccttgtcctctctgatccatttttgttttcattcttagatgcccctttgtctggccaaccctcaagttgtatggaccactatacctttcaccctatacagttgagggagattggttccaggaacccccacagataccaaactctgcaaatgctcatgtcccttatataaaatagtatggtatttggatataatctatgaaatcctcttgtatactttaagtcatctctaggttacaaataatacctaatacaagtactgcattccttgaggtctgtgtcttatttacccttttatctccagcgttcacagcagtgtctgacaaataattccttcatttttccccttgttcctgactttagagtcttccttttaaaatataaatcctgtttagctctgtgacactgtaattactaccaactccatttagatattcagcacatatttgtaatagtatcaatttacatgtttattttatttacaaataactcagtgaactctcacacagatccataatgttgtcttatagttattaggcagggagtccctcatcttactcacaggctataaatctacctgcatctacacccatcttctcctccttccctcctttttcaatagagatatacagttcttatccacatttaaatatcttcaagtctctaacatctttaagaaagaaaaacagactctctctctcaatcccatattctctagatatcctcttatttttctcttctcttacgtagcctgactgctttgaagactcctcaacccattcgatgctggcttattgccatcactgtgaaaacaactctcaggaatatcactagtgactttcacattgctatatccagtgagaacatttcagccctcatcagtatacacatactaatggagaatgaaagaaaaagaagattgtatagggaggctacaaagtaattctagttactttaaggaattttgagactatagtaaagacatctgtggccttatactagaccctgtcaggaatcacactgcttttaggactgactcattttctttctcaatggctacataatctctctgtttggaaacttgacttccttttgcacatcttttctaatttcatctctgttttttctattctcttataatttctgctcctccataacttcagctggaatgtagccccttatagcctctggtctccctccttgacataatgaggacctcttagtttcagctaattgccttattttcttggtattctttacttaaatttctagagcgttagttttattagtccagttcatcatttgtatcaggccacttcacaggtgattgaaaccgcctcaatctatagcctagccaatcacttatgaattgccctgggtaatcctgatttctacttttggatttgagtaaaatccaaatgataatggattaaggagcgcatcacaggtgaggaaataagggtaagggcttgaatccaaagagggtgacagactagtggggagcacacatgatcaacaaaatcaaataaaggattttgtgttttattttaagatggcagagatttgaacatagaatgagtcaataggcaatagttgaaacaaagagagaatttaattttttagttattgaagttgtgttaaggtggcagaagatgggactacagagtacagaaagatagattagctttaaataggaaggatacctcttcctctgaagtggagtttaagtaagaaagtaagaatttgatgcagataaatttgaaaataggggaacctgcctgttggcatactttatgaaatagtcagcaaggagaactgcacagaagaaagataaagatttccagtacgtgctgaggaaaattcaactaggtacctaacaactacgagtatgatgaagtgattttctttttcactgtagcccatatgtaggttaagaaagggcgaaggatttggctagttcagagttaaaatggacttaatttgtgacatggtagcattaatgcttgcttctaacccacccttcacatttatttggtttgaccatgttttcattctggtctttcatacttttattttgtaggtcttgatgactgtttgcagcagtatattaagaactttgagagggagaagatcagtggggaccagctgctgcgcattacacatcaggagctagaagatctgggggtcagccgcattggccatcaggaactgatcttggaagcagttgaccttctgtgtgcattggtaaggacataaaactggtgaagagggaaacttctctttttcttcttttgttgcttttcccttttttcttctcctcttttgataatcgaaatgcaaatagaagaaaaaaactctgattctcaaccagctggacctgatattttcttccttccttaaatttattatattagtgccaaataacagttccctgtttgtaacatcttttataacagtaagacttgggtatatcagaaccttaagtccagagtgtatgtctcataagcagggctcttcatagatgaaccactcatgtgctaggctctcacactgccagttgagaaaggaaagaatattgattgacagtgttacatacatacagtctagacgtttgaagtttgacccatgaacaaggctctgccgacctaaacctacttaaaaggatggcatcagaaatagatgtctagaccacttctaagtttgaaccatgtagctgtggtgaatcctttctgatgctgagctttaatccctgtacagttctgggtttaagcaccaggtttaagtcatgtcatttggatagttcattatgtgattgagctcttctggaagttaatgcggaaaataaatttaaacaccatttttttttctgtttattcagcaattccttagtcgcagtccccaaagaggtcaaatgttaaacttccttcttaccccttcctaatgtagtggatatacatcaacaagtcagaagtacagatgtatttcagtttatgcaacagatgctttctggggaatataaagcaaatttctgggtagtgaattctaattttcttctacataccattatgaaatcaggaggtgagattccttatcaacaagctgagttgactagtccaggaagttgtgctattgggactatatctttacctccttcccctctatccccaactactctttgaatttccgtttaccctgctaagtcttgtctctctgatctttactggcctttctacattttccttatgtctactgtattcatttctttttcaacaattacatattcatgctcaaacagtgctatcacggggaatgcaaagatgaaaaagacagtctgtactcctgaaacatatacagtccattaagaaagacaatagccatcagaagacaacatagatttaaagaaaattccaggggagtgtagaaggaaatgaacacttctgagggattcaggaagtgtaggtaagatatgcatttggtcttgcaggatgatgagatgtttgccagacaaaaagttggagaaaagttatctaggcagaagaaatatcatgtgtaaagacagaattgtgaaagaatatggaatattcagagaaaattgagaattttcatttagcttgtgcagaatgggaagtgatgggaaaaaagggaacttaacaccttgtattacaattctttgcttaggttcttttatcctttaattcatgttgggctcctcaaaggaagacatctttgtttagttcatattttttattcagctttctgcccagtgcttagctcataaaagatgctaaattaatgttatcttactgaattaaactctctgtctttcttcagagaagcataatttttctcttacctgcatagcctttgactttgaagtttctgttcctcatataaaggaagacatagaaaaattagcagattccttttgtttctttaagctatactatattttcgtctaccttgtcttgaagttattccttatgtgaataaatgtttatggcagctgatgagaatcaaaggtttatttagtcacttgtttattcatgcaacatatatttattaagcatcagatatattgtttgcatcatgttattctagaaagaagtaagctgttcatgatttggaggtgtaataatatttcaagctattaagctataatttagtatgctttaatagagagcaaagatattaactgaaagagtaaaaatgtaaataaaaatatatatatagcttaacgtatggtccttaatttgtgttctgacaatacactttttattaggaactgtaaataaatcatttatgacaggataagaacagttttcatttcatttttcatgtacttataatttcaggcattttgcatgaaagatttgatgtttgcaattgctgggatttgtttctttgcaacataattgcttggttcattcatcttaaaataatttattttccaaaaaaattcattaaagcaagccttttaggactcactcatatttataaagcaatgtattataaagctaaaaaggtgctacacgatgcattcaaattaagaactctgaataaaatggcattgacattgtaaaatctgttgttgccaatattaagtatttctagttaagtggttagtgaaaatttgccactagtgaggatatagctgaccttatttttctaaaatgttaaatacatttctttatttctttcaaatgcttttgcatgcatatgattgaaagagaaggctgatatgaacttagcataaattcattaagacttaaatggctgtgttgaatcagttctaagtcattactggttctggcacatggtaatggccaagtatatgaacaaataagtaacatatatgacaaacacagcagctaagtacatttcatgtataagtttttgttttcttgaggtagtcctttttatactaatagtaataccaagttttgctatgcatatccaataaaaagcaaatctgtggtgaataaacctgcatttttaaaaagttgaggcagtgccctccgtacccctggcctaacacaaaaggtgcttgatatacttgtcagttctttaaatggtaggtaagggtgtgtgatttactggtgacttaccatgtcacaacaaaccatccacttacatgaaagaaatagccagaaggtatctgtattggtagtaattgagaattgtaattataaaaattaacctgaggctgggcatggtggcatgcctgtaattccagcactttgggagcctgaggagggcagatcacttgagcctaggagttcaagaccagcctgggcaatgtagcaagaccacatctctacaaaaaatttaaaaattagccaggtgtgctggcatacacctgtagtaccaggtacttagaaggctgaggtggaaggatcgcttgaacccaggaagtccaggctgcagtgagctgtgataatgccactgcactccatcctgggtgacagaacgagaccctgtatcaaaaaaataaaataaaataaattttaaaaattaaaaagttaacttgagagatcaattaatctcttttgttaaaatagtagcacataaatctggttacatacagatgagcttcttacctattatactcttctaaatttttaaaacatgtttttagattatcagtgtagttatgttcattaactagagcaagttttaacaatttccttccccatcctctgctacatatcttttaaagattcttttttcctctgcatttctctgtcctctacatttttcacctctattctgcgtaatatatttttaggaggtttccaagttagaacctctgagagtatccttccaggttttgtccggatgattattatattccctaattcttgagtcatatgaaaaataataattttagtttcttaaattttgaagactctggaatatttttactttgcctttggatttttacttataagaagattaatattattttacctttcctaataaatcatttgagatgctagtgttatatagagataaacaatttaaaataatcttttatggaggctaatagctacagagtgaaatatcagttaccaagttgagtaggtttctcgctaataaattgttataatttgaacttctctaagagattactataatttgttggcaaacaaatgttttcttattaaactcatttatacacaaaaatgaaaaatacaatcattttttactttagaaaaatgctttaacacagggaaaacttctgaaaatactttgcttttcagtattttcatttacaattacatttacagaagaaatatcatttacagttagtttgtatagttataaattgttcttatctagtcattagagagcatcttttataaacataagaggatttctttcatactgtagtgaccggctggacaaactctcccacatttcacaaataatccattcttaaatgcaatagaatttgaatagaatgttgttttatttgcccaagcaaatcttttaacatgagagaagaatattacagttcaaattaagcagtgaatatttaacatattaatactatgttattttagaaaacaaatttataactttagaagaaagtgttcttttaataaatatgtaaattcccagcaaaagacaagcagacttttatcacgattaaatctgtagtggtaacatacataacttggtatttaatgtttaggcatcaaaaccttcctctcccctcattttgtctccactaagttttctcttgtcttaaattgtcataggaaaaaaagacacctaaatgttatatacaaagtaggtacccagtgattgttgacttaataacatagcttaattcattgtatggcttactttcctttttcacccttcatcttccactttgacttaattattgttaccatgtttctgagaataggagtagaatattggtgctaaggaatgtggtagacatatccgctcacagatggcctggtgacttgtagttccattctgaactctgtctagtccaagtacagagttttttaagcaaactgttaaaaaagaaatcttcccatacctcagtttccccaactgtgaaaaggtaagtcaaacttagcctcccaggcccaagcaaattcttacattctttgggttttgccattttaagtaaggtggtaataactttaactttacacacaacagtaatgtgcatgctgctaagtgttttaatcaaggttatccttggataatattaaccagcctttttaaggggtgttttacaacacacaattagctgctttacattttaattgtaacttttgaaaactttccccaaagtttgaagggatcctacaatctttttctatttgaagatagtaaaaaggcttattacacttattcatataacccgtttctgctataaagtataatagataagatatttaggatgaattaacaaatattagttgaaatgtgagaacaaagaaaagaagaaaacaaatacacttaccaaaaagtcactgtgattgcttttggtgtgcttcatatttagttgtgagctaatacagccaggacaaaaacaaaaataattttagtttcataatttgtattacaaaaaggagaaagtatattagttcccctgaggaagcagagtttttcctgataccatattataaaagaaacttcttatacatcattatgtagagtacgtatttttttatctgatttatttacctgatttatttcttgctttttcattttattattgttggttgtgtttattttcctaactttggggaagcagaattatccctagtacctacattcctgaccatgtgtattgttaatagaatatctactcaaaaataattgttgataataattaatttcacaagtaaataaacttaggttttggttttaaaaaacaaatttattatttcttacaatcttgctttcttgggtagcatagttctaagatacaatgcccttatctttccatgttcatattagtacttaacacattttattataatttctttatatgacatcttcccaaatagtcacttaactgtgggctccgctaggtcaggaatcctatcttattcatttgtaactcgaatgctaccccattgcctgtgcataataaagtattcagtaaatattttcatgaatgaataaaactgactttaaatatattctctctcttttttataattcagaattatggcttggaaacagaaaatctaaaaaccctttctcacaagttgaatgcatctgccaaaaatctgcagaattttataacaggaaggagaaggagtggccattatgatgggaggaccagccgaaaattgccaaacgactttctgacctcagttgtggatctgattggagcagccaagagtctgcttgcctggttggacaggtaaagtcttccgcatgtttcataagtatcctctcctcagacaccagtttgaatataacattattttgcattttgttgtgaaaggattggacaggcagaggagtaccaagtaataaatgtctaatgatgatttaccacaatataggggtattaaatagatattagtcttttataaaatttgatgtccaactaagtagccaatcaataattagtctgacaactgtaaaataccttgctgctttataagcaaaatcattatttggctgtcataataaaatttataaatttttgtttattataatactgctttgtgtcctgatgttctttattcatattaattggttgtacttaaggaaatgaccattgggattctataaactgttttaaataggtaattagacactgacaccttcatagcatgccttgtatgtctccttggcctcgcttcattcattctctgttattaattacattgtactattttggatatcataaacacacttttagacttttttaagtttagttgactttcatttgttttggaacacataaaatagtataaaagtcttgtaatatgaaatgaaaatgttagatttaaattatatactgtatgtggttaaacattatcatgataaaacacattacaactgtttattaaaaaactaaacaaattctctactttcagttttggaatttttggtaaggggtatgtactatgtttaatggcttaataatcaaattttaaaaatgctctttgtctttcataagaaactctgataatatacattaccagaattctttcttgaataattgtcagtaggatattcatatgtgttcctacacacacacacacacacacacacacacacacacacacacacgccagtattacattttggcattttaaaaacatgaggccttatattaaaagtaaagcttttgtatttttaaggtgaaaattgagataattttccttaattttatattgtctaattttatatatacttatacataatataaagtgatgatactaaatccaaatatgaaacactaaactatatattactagctttttgataattaattaatggactacatgtttattttgcattataacattattaaaatttaattttcataattgtctaagccacattatcaagtgtttaaattaattgaattttaaatatatacattccaaaagttatgaatggtcagtaagtaaaatatggcttagtccttaagtactattaatataatacatttgttttggtaggctttacagtaatcagaaggcttaaagaacacatccttgattataattgtatcttcttttactctcattttccctataattataaatttgctcagccttgatatctgcatttagtaaattcatttatatattttttaccctagtatttgttagatggatagataaactgttagagtgaatagaaaatgtttttacttcttgatgacagatatggctatttataaaatcgcacatttcccacactatagtagtccttgagattttatcgtatcaattttttatggtggtattactttcattatgtaataaaatgcttttggtaagtgccaaatcacctacaaaacacatatgtgcatgcacacctacaaaagcacataaaaacacacccagtgtgtcagtgcagatttgctttaatttgagggatttaaaatgaaccctgcaaatgaatactgccaagcatttgatctttaactttagtttattccttcaatatacaatactttagatgaagaataaaaattttgtcagttaaataggattaatttgatgttataagcacctgttttcatttttaaacagctataagttttatggcattacaaaatttttattacattttggagaaaacgtgtatccacagcaatatgttttgggtttattacagtttttattttatgtcacttgaaagaggagaaagaaaaagaaagaataggttaaaaaaaatctttaattttattctagatgctgaactagatgctttatacataagtatatatactctcagctcattgaattctcacagagcagatattgttatctccattttacatatgaaatgtgaaataacttgcctaaagtcattcatctagtatgaaagttatactttgaatttatttttgtctgacattgaagtcctgttattttttccttcatgttcctttatcatgctacacctcgttttgaatgctgactaattcttgaggattttgaggaagggatatggcatataaacctttatttacattttgctatttctcttcaaaagctaaataagactaccacttttctgttttgggcctcagtatctgaaattgctacatagaacttcatttatagaaaatgtttatttcactgtttatggtaaaagtttactattttctctcatttttaacattaatatttaattctaattgtttctaaaatacctttcaagattattctattttaaagggatcattgaaatatttttgataacattgcaaaacctttaaatgtttagggcgtaatagtgtgctaggaaaataatatttatgactcacaaaaactccagtttcaatggagcttccatttaaatgagatacacgttcaaagaccagctccttacatttcctaaataagataaaatctaaggttaacacaattccattttttctcctatttaaaatattgatttcagtgaaacaccagactttcccagaggaatagtctcagaggtgaatcacagttggtagctttactgtttattttcaatgcatggtttacttgtctgtttttaacctacatcctactgtttttgacacctcatatttcttgcagttttctgtggctttgccaaatcgatctatactcagaagtttacagatcactacaagtgttacgttgtacagtaacattagtaaaaatgttcaaaattattattaaacaaagtttattttgcctttcatagtaaaagtttttttccttcatttttaccagtaatacccaattctgagagtttataaaatacctttttaaggtcatcctgttttgatgggatcagtgagatctcttgatatcattgaaaaccttttacatatttaaggcataagagtttaaggtactagggaatttttgttaagatttctctgaaattttttgtcttatgtaagaaaattgttaaactaatttcttcttccatgataagaaactaaaggacaaattaattttataccaggaaaaatattacagagaccaagaaaaccacatcaaacgctaccagataatgtgatccattgtttggtcttattttctctcatgtgctcattgtttctcacttagcactaattattcaagggaagagcagtgacattagcactaccattattcacagactaccctaaggtttcagcagtgccaacctgagaaatagtaaggcattccagattttccttattaacctcttagctttccttattagtttctaatttgtttaggatttctgaatcgttaataacctttttataaatgtaatacttttgtttagatataatgtacaaagaataatttcttatagggtcttaaacttttgcaccagagagaaatataagcatcgtattatctatatgatgatttaaggagtacagtcgcttaatttttaagatttaaataggataattcctgtaacagccacttatcgatgatccaaggattttatctttttttctctttctggcatcaaaaagctttcttgctatgaatttaatttcctttaattagagttattgtgttcttcttgtaagtaccctgaactctacttgaggatttcttcagacttaagaacagtttctttatttttgtttttgtttttgtgtgtgtgtgtatgtgcatgcatgctgatcatgttcagttattctacagagatctatcgtttttactctcatagatgatcattaagtcatgactgagtgataatctttggtaacccacaaagattggagccccacctgaccttttacccttatttatatgtagatacagcccaaatcatcataccaaaccttaaaatctgctggctaagaatggctgttagtacagttgtatatgatttgcctctaagataaaaactttagggtaattctaaatcactacaaaataaaatctgttttccttggtatgtgtttagatttttcttttcattttttcttgaaatttaatcttgagtgaaaagcttgtcctacttaaaatatgaatggtcaggaaagtggaagacatgccttggaattcagtttgctataggcatttagtgatcaaatagattttttcttttctatatttgaacatcaagtgagattcttttaagtagttatggtaaaacaaaacaaaacaaaacaaacatgctgtgcatcacctcatcacttcttaatgaaattttaagattttataaacagactctgaccttttcaaacctaggaatcgaaactcttttctaatcatgccagaagcacttttgaattcttagtttaaaatgccagtttttatgcttcaatgcagcaaaaatggtctctatgtagttttttttttttttttttttgagacagtctcactctgtcgcccagcctagagtgcagtggcgtgatctcggctcactgcaacctctgctgcccaggttcaagcgattctcctgcctcagtctcctgagtagctgggattacaggcacccgtcaccatgcctagctaatttttgtatttttagaagagacggggtttcaccatcttggccaggctggtcttgaactcctgacctcgtgatccacctgcctcggcctcccaaagtaatttttttaaattaatgatattctcctagaagtgcttatatttttcattaaaaatatttttattgaggcctaatttatattctataaattaacctattttaagtatacagtttgatgggttttagtaaattttgataacacctaatacaaccacctttacaatccagtgttagaaaacttccatcaggatggatttttaacagttggtttctgcttacaactaaagaggttaattttttttaactgacaattttgattaatcacatttttttctaattcagttttttaaattcttatgtctccttttatttaagtaaattatcttgaaaaaatatactgggtttaggagtaggaatagataagttcatgaaagagagcctataatacactgtggtgtagtcatgcattgctaatgataaggattggcaattttgttgttgtgcaaacatcatagagtgtgcttacataacctagatgatacagcctactacacacctaaactatatggtatagcctgttgctcctaggctagaaacctgtacagcatgtgactgtactgaatactataggcaattgtaacagaatggtaagtatttgttccatatctaaacccagaaaaggtacagtaagaatacagtattataatcttatgggaccattgtggtatatgcggtctgttgttgaccaaaacgtcattttatgcagcacatgaccgtatatagaatcatttagaaaacaatatgttaaaaccactagaaaaagaaagggccatttaataaattgtagtggggcgcttggttaagcctttggaaaataaataatgatagagcactatctatttttcttcactaaaataaattttagatatatcagatatctaagaagaaaatataaatttacaagaaaactagaaaaaatataggcaaaaatgatttctagatgtggaaagactttctaagtatttttaaaatggaataaaatacaaaggaatgtactgttgactacataaaaaagaaaaacgtaataaagtataagacagaagacaagctgggaaaaatatttgcaacaaacagatatgaaaagcagagggttaatgtgtaatgtgtaatattcatatattaacatatgtgaatattcatattgataaaaaacaaagcccaccaaaacgtaacagatgagtatataagtaggtaaatcaaaaaagaagaaacagaaatcactggtaaaatgtgtatatcaaacaacagagctttaaagtgcatgagcaaaaactgacagaatgaaagaggaagtagacaaatccacagttgtagacttcatttcctctttctcaagaatagataaaattaaacagaaagtaagattagaagagctgagcaccaccacctaagaacaggatgttttgacatttttagagcacttcatccaacaacaggagaataaaaattcttttcaagtacccattgaacattcaccaagatagaccatatctgtatcataaaacaaaattcaacaagtttaaaagaattgaaatcagataataaaatgaaactggtaactcatacagcacacttataagtaatccaacggtcaagtctcatggaaaataaaaagtaatacattgaacagaatgaaaaaagaccaaatcataatttgtggcacacagctaaagcagtgctgaaaaggaagtgtatagcactgaatgcttatatatatcagaaatatatatattcaaaatatatcagaaatatatatagtaaatatatcagaagcactgaatgctttatatcagaaaagatctcaaatcaatcatttaagttcccatctcaagaaaatagaaaaataagaacaaaataagtacggagcaataagatcctcttaatgataagagcagaaattagcaaaattgaaaacaatagagaagtcaatcaaaatgtaaaggttaatgaacaaatattacagataacttcacatataaatttggcagctcagatgaaatggtccaattccttgagaaacggtactaaaacaacccaaaatgaaatagatactctgaataatcccataactattgaagaaagtgaatattacctagaaacgcctcagggtgtggaaaaaatctgcaggctcaaatgatttcattgttgaattttatatatttgaagaagaaacaccatttctataccatctcttccggaaaataaaggcaggaacttttcctatatcattttttgaggcaatcattatcctgatatacccctcccccccaaaaaaaaactacagaccaatatttctcaggaacttagatgttaaaaccttcaacaaaatattaccaaactaaatctaaacgtgtaaaaagaattagacacatgactaaatgagttgcttcaaacacttgaagatacatcagtatacaggtccaccatttactagttgtgtgaccttagataagtcacttaatctttctctaccttatgcttctcctctgtaaaatgagaataataatagtgcctatctcataatagttgtgaagattaaattacctgatacaggtaaagcatttagaatagtaactggcacatagtgagccctcagtaaaccttagcagttgttattactagctcttgattgtgaatattctaagtagatactgtactcagaatcttagattcttttgaaaataaactgacatgttatctttgcctaaagtattccttttttgttttagatgtagtgaagataccttgtaagaaccaaagaacttaaataattaagaactttaaaaagagagaaatttggtagaaagcaaacattatatttcctgaatttaattttcttccaatcatttctttcaaatctttccttaaaataagtcctgaatatttttatcagtatggaaatttcagaacaatttatttcatattattgataaactcattttaggctactatattttgggacttttcaaaagctgttactagtaatcacaattttccttttccctttataggtcaccatttgctgctgtgacagactattcagttacaagaaataatgtcatacaactctgcctggagttaacaacaattgtgcaacaggtattagctgacaaactttccttctgttaatttattagcaacttcatattccaacaatgggaagtatcctatgtaccaagagtttttaagatactggtttagaagtttctcaaagacaaaccattctaaagaaatgaaatgtgtagttatttattgggagactgtgcatttagctcagttagcttaccagaagatataaaaggaacctgacctgtacacacacaaacaaatgtgcctaatagcttttaacagtgatctaattacctgaactgattttccacttcaaatattatctaagccagggatccccaaaccagatgccttcagggtccagcagctaatataaatgtttaaattaagtccggtataaggcaaggagaaatggaagagacttgggtgaattgactggaacatatcccatatccaaacatatcttttagaggaaatgtaattataggcatgatatattagtgcttgtaaattatctcttaaataatctgttctttttctactgttatgtgatgatatctcttttcagtaccaagtttttctgggctctgtggtctcttgctaccagtagtagcaagaagaataaggattaataggtaaaataatgaaataaaatagttaagtgtttatttctttatggtgaaactatgggtgattttatttagactcgacttttctctattttccaaatgaatttttattttctaaaatgaatttgagttatcaaaaaacaaaaaagaatgttaagtacattgaagaaatacctctttaagtttgccaaaggaacacagcttagacaaatactgaaattatactttaaaataaattacatagcttacgaacagttaatgttcatctaatcatctaattcagccattatatacatactaatcactgcatttgattggaattgtatgaagtatctgaagacaggaattaaacttaagctgccagtaaaagaggccaatttgaataagcaaggtgtagacttttaaaaaaatctaggacatgcatttattaccaggctttcaagaaatctcttctgaacagttatgatgatgattatgctttgaaatatgctgtgcttcaaattatttttcattcagctttaattatttttattccctttgcagcaagatgagataatcaatatctaaaaataaactgtcacaaatggcttttttccccttcctaaaacaaagtggtgctactatgaagtaaaaggaaagtgcttcttgatattggccacttacatttaaaataatactaaaattagaggagaaagttaatgtcagtttcttttgaaaacctccatttgcaggaatttgtttaatctgctatatttattttacttattcccagttgtgatgggtttggatcattgtatttgaagccttttaaagagatttccgcccccctccccaacactttcctcatcacataagattggttataatgacacttttgaaaaaaaaaaagagaaactggttttaaaatcttaaatagaattctcacaaagaactgaagcttcatttagaacactgacagcaactgaatcagaacaatgagacaggtacccacacactacttgtcagcctttaaataattgccatgatgccttccttaatggatatcagcttaacctaaaattattctactgtaccatttttatgttctccacttcaaacacaaaaatgatgaattagattgccactagttaagaaataagcacaaaagtgttggtttgcaagatgaaactttggtgaagcttaaaatacatggggcaaggttgtaatcttggaagatttgagactcagccctgtttttcatgatgattccacattggacaaacgatgtcattgttttcgccatctgtaaacagaaataatcacctctacctcaaagtttttctgagaaccaaatgagatttatttaaaaatagtgaagacttagaatcaacctaaatgcccatcagtagtagactagattaagaaaatgtatatatacaccatggaatactgtgcagctataaaaaagaatgagatcatgtcctttgcagcaacacagatggagcttggaggtcattatcttaagcaaacttaacacaggaacagaaaaccaaataccatatcttctcacttataagtgggagctaaacattgagtacacgtggacacaagggaacaacaggtactggggcctactcgagggtgaagggtgggaggagggtgaggatcgaaaaactacctttcgggtactatgctcattacgtatgtgataaaatctgtacagcaaaccccatgatacccaatttacttatataacaaacctgcacatgtacccctgaacctaaaataaaagttaaaaaaagtaaaataaaataaaatagctgatgagtgtaaagtgaaaaacaaagatgaaaataatattatttacaaaaatgggtaaggaataaagagacttgataaaaggaagtaaaataggaactttgttttgaaaaataaatgtcagagatttttttctccatttggtgttagttttcatgagctgcatttacagtgaaatctgaattaggtgctgagggaaaaattcaaacatgttaaagaacattttaaatcagattttgaagtgttaaatacagagtgaaaaattcctcttaaaactcaagttttgatgatatgctttttacctgaactggtcctctctaaactgtatttattaaaaatctctgcttgcttatgggtctgttcatttctaaccttcttagatccattttacatgttcttggttatcgctggttgtctgaatagtgttaaaaacattttacagaaaactgtaaggaagaatatttacaataatccaatcctaattacgcagaaacaattagtgctgttgctttggtctttcctgtaataaatgtctttacttaagttgttattctggctttctgacagttcttttgttttactttgttccatatttacctgtcagatgtattttattttctaaacctttgttcaagtaaatggacaaatattctttaaacatcagtattaaaaatttttatttttgatggacagcctcctttaaattatgtgctttctattcacttgtgttacctttatattattttaaatacagaaaataaaagtaaataatttatgaaacatcctctaaatctgcatcttaaaataaagatataaatgagcatattgagtatatagccctttttaaatgtattcctgctcaaatgtaatataaccattttatctgttttatcttaagttgttaattgctcaaggtaaatacttgagaagataagagtttttaggacttattgaattgggatttgtgttttaactgcttagagcacaaatttgtaaatactgtttagaaagattataaaattttgttaaaatgaatagcccagaagtaatttttagtttcattaaggatttattcaaggaaatttagcctgtagatttattgattatagatattatattttacttaattacattcatgtatatgaatagtacttcatttaccttcttagttgacatttcatatcatttactttcacaatttatggcaaaatagtgtagtgggcactgacatgaagtagatccaagttcatcatcctggctttgcttttcaacaaacagtataaacttggacaaattacttcatatctctgatattatttttctttttctgtaaaagtggatccctaccattttttagattattgttgggctgttgtgaagattagaaactgatttagcccaccatctggcatatagtgggagcttaataaatggccactcgagttattttgtgtagcaaaagagcctttggaaatgctaaactcagctagtttctcgctccacagaaaatttcaaggagtgatgctctgcttacttttggtattgagtggcaatgaagaaagatctcatttctaaaatgtgatttaaaaaaaaaaaaaaggattttagtataattcagaatgttctttagattttaatgcaaatttattactgtgcttcattttctgcaagatatgttgaaacattcatgttcaaatgtaatacagaaattaattttgattacccaggaatgtatcatctctattcacatattcaagttcaagtagtaaatacacgtaaagatgtaaaatggggatataaattatgctggagtaggcaaggtacgtattctatcgttcatatggtaagtgttgaaagcatatgaaaagcctgtccagaatggtctcacagacatttaaaacacaactttaaatattacttttactatgtactcagagttagtgtttaaaccttcctgaatcagacattctgggtgacctgaaaattatattggggctcttgagattgaaactgggacatttcagaccaaaaaacaggacaagctttatatgcatttttaaaacaatatggattatattagcatactcaattaaggcaatataaaaggtgaatgttttttcacttttttcttttatttttagttgacacataattgtatatatttatggagtacagagtcatatttcagtacatgtatacagtctgtaatgatcaaatcagggtagttagcatatccgtcatctcaaatatttgtcacttctttagggtgggaacattcaaaatcctcttttccagctttttgaaaatatgcaataaattattggtaattatattcattctacagtgctatagaacactaggattttttcctcccgtctagctgtaattttgtatctattaactaatctctccctatcccctcctctctcctacccttcccaacctctaataaccacaatctactctctacttctatgagctcaatttttttagctttcgcatatgagtgaaaacatgtaatatttatctttctgtgcttgacttatttcacttaacataatatcctttagactcatccatgttgctgtgaattataggatttaattctttttatggctgaatagtattccattgtgtacatataccacgttttcttcatctattcatctgttgattaacatttaggtggattccttatcttggctgttatgaatagtgctgtagtaaacatagagatgctgatatctcttggacataccgatttcctttccattggataaatacctagtagtgggattgctggatcatatgatagttctatttttgtgaaatatacattctgttttccataatggcactacaaatttacattcataccaacagtattttttcatttcctttctgtttaaacaaataatacttttaattcagttcaattatactttatcctttaatttttcttcagccttttactttaattataaagaagcaatatcttttcaaattttccgtataatgctaatatagtaagtcagaagttagatataaaactatcagaaataatacccagataacttgaatactttttttctgaaaaaaaatgtaaaaactaaaaatatattgttttcaaaactgaaggaatgttatatatgtgcacctgtatcttctcaaaggtgtgtgtatgagaatattatcaaaatagatataaatacacatacaagaaattctcattcatgatattaaatacctaatttttggcagctgcatatttctgaaggctcagaatgaagagataagagtgatgacatcattgcatactaatacttagcaaaggactctagaagagtggggcataataacttattattcctgcagctttctgatactggcctggcttgtgagcaaaaacttaaagacttactgtgtatcatattaatatggatgctgaaatagattgttttcataggtttattcttttataaaccaaaactatattgcatgttatcagagtcgccctgccaaagcgcttttaaagatattatcaccatcaataatatcagaaggagaatagatgagggtgtactaaactcatcaattccttttagatagcaaatagtagatcctatttctcagacatcttctttcttcactgtattacattttgaaatttatgaaatgtacatacatgcaaaagaatgcatatatgtatgttatgaagaataataataaatactcatgaatctgccctctaattaaataactacagcattaccaatattgtttcagttacttttgagctcctctcccatttcatcagcttgcctcctcaaggtgtttatcattttatttgttcttaaaatagtttcagatacttctctaaatgtatcatttgattatgcttgtctttgagcttgtaacaatgctgtcactctgtttcttactgttttcaatttatgtatttctgaattcatgcatgttttcctctgtagctgtagttcattcattttcactgcatataatattgaattctgtgcattatgtgcataccccaatatgattatccattcttcttatcatggacatttgggtatatacctacatttaagtgtaattactaggagtgtaattactaggctatacagtttgcatatgctcatctttacagctgtgaatatcatgttctcaaaattttattgcttattatgtcttgtactttcattatctttctactatctgaattactgtatttgagtcctattatgcagttcacctttgaagaggcttttatagttttctcacaaagaccctaagaagaggtaacttttacctttattcctatactacatatagggatacagatgtagaaaggtgggttaggctatttttgatcctcatgagtgataaaataaacttcagaggagagtccctgatatgctaccatttgtgatatactgtgactattctttttaaagaaccaagccaacagtaatagttcatttaagaaaagatttgctgtgacagacttggaagcaggagtagtccccatgctcttctgtgtctccagtgcctggcaaataagtgtttgttgaaagaatgatgtaattatttttcccttaaaagttcaccaaaaatgattacagaaatttagaaactttaggagtttagaatcaagtaaagagctgtttcaaagcactgatgcctgaaccccatactggacccattaaattagactctttgtgatggggtttggcatcagtattatagaagtgatgcctcaagtgattcaaatacgaagccaaagttgatagcaattgtgctatactcatactttagaaggagacaaatatgaggtgggaaaaaatgcatgtaattaagaacagtgtttcccaaaggaaacactggaccatgtttccatggaccatgattcatctaaggaggcatactaaaaatgcagattctttagactttaccacaggctgaatgattgagaagtgtggatcaggaggttcaattatttataggtgataacagcccagagcctatacatttataaaggagtctggttagttttcaatttataactgtagttattagtgggttatagtccctctgtagtaaatacatatccaaaaggattaggcgtgttctatgaaacatcaaatataagttattaaataaaaagtggttattgcacacttgtaataagaaagagagaaccaatgctagaaagtggtgtggtggtagtagacaggggaaggcactaaggttagtaaaacaagaagcaataataatcattagtaatgttttaagcatttattatatcatattgtaccatacatgaattacatgacatagattttcatacctacacaagatgaaagcagcaaaccaaataaattatagttactattaggttggtgcaaaagtaatcatagtttttgccattacttttaatgcttattatgtcttgtactttcattatcttcctcctctctgaattaccatttttgtcatatgtcataatattaatattacttttaatggcaaaaaacacgaatacttttgcaccaacctaatagttataggcactgatttattaaggcatttcgcttctgctgaagaagtagtttttaacatcccagtctgcttaggttgggtcagaatgaccaccaacatcagataggtaattcaaataaaattaggccctaacacaagtaaaataatggattgaaattgtaaatgacagcggcaggttgaagaactggtcagaatcaagtaattaggacaagtgagcacaaatcaaacttataaaataagtcaaaatttatctgttaaaaccagattgggccaggcgcgttggctcatgcctgtaatcccagcactttgggaggccagggcgggcagatcacctgaggtcaggagtcaagatcagcctggccaacatggtgaaaccctgtctctactaaaattacaaaaattagccaggcatggtggttcatgcctgtaatctcagctactcagtacactgaggcaggagaatcacttgaacccaggaggcggaggttgcagcgagccgagatcacaccactgcactccagcctgggcagcagagtgagactccgtctcaaaaaaaaaaaaaaaaaaagccagattggaaaagactagatttgcaaggaggtagcagaatgtaaccttaggttgactgtgggtaacagtatgtgaggcttgacatagcaccgctaaaaaaaaacactaataacccatgaaatgaagagatacagcctggaaaattaacgaaatggttattgcattaaaatctgcattggttaggtcttcatatgcacatctgtcttatgtttcccttctattggtgcagagttgtattagtcaaggtatactagattatgctgcagtgacaaacaacctgaaaatattagtggcttttaataatgctcatatcaaatgcccatgctccatgtgcatcctgggttgctatagctttactctatgtcctattcacttcaaagcccaggctgatagagtagtctcttctagaaaattgctggtcatcatggcagaggaaaaagagaacatggtgaaccatgcattggctcttaaagcttctgcataaaaatgagacctaacacatctactcacaattcactggtcaaaacaagtcatatagccatgactgacttcaatggctcaaggaagtttacttttccctttaaaaaatggcaggtatatatttggaaatcataatacagtctgccacagcaatcaatctatgaagaattccagtataacattatactagaattttgaggacaacaatattttttatttgaatgtaacctctctctcctcaatactgaagtgtgtttgtactgtgtgtgtgtgtgtgtgtgagacacagagagaaagaggatcagtcggtattttaagtgtaatctgctggaatatgactggtaggtttcagtgggggacaataaatgaccttttggattttgtccaagcacaaaattctggttaataatcacttggtactcggcgttagtactaggaaacttaaacagatatggattctatggaatatctcttttcaaggtgtaccaaattaagcctagatttaagatagtactattacttggacaatttagtatttattaggatttttatatcttgtcatcatcaatgatctaaaactattttttgcatacgcggacataactggcgctttttcaaatactgcacacaattactgaaaagaaatgattccattttttacaagaaaatgcaatctaaatagataaaagagacaaacgtatagggcctgaggaattgtttaaactgacagtagaaattatataccataccatctctattttatgacagccaagtgaataatcttgaattaaagaattaatgttgaatttatatttttatttatgatagtatttgattttagttttgctttgcaccctttatttgagtttattacaagggaaaaaatgcctcccattgcttagaccctatagagtttcctttccttgggatatagtagatggtcattaccataagcaacttgaatatctggaagctagagagactttctattacaaagaaatgttagcctcattctatgactataaagttcttgctatcttttctgtaatacaaatcttgcagtaaaggctcaactatttttgttaaatatatcttctgagatcaagcagattgaagtttaaaaccaaactcacatacaaaatgttttaaaaactgtgaaactcagtctatttttgtataaaatagaagtgtgaagaaactaagtgtactgtactagctttgcaattagaaattttattttcaacaatatggctttatgagttgcatttttatactcatatgtaaaatcaatgtgtaatatttattacagaaagtgaaaatagagaatcagtgcaataaaatattgataacagataaattcagattatagagtgtacagagaaccttgagaaagtaaagagacattgaagttgaatatggggttccttctctgaaaatattaacaatctaatgggaaagactaagactagcaaataaataactgatgaaaacataaaatatctagaactagaaataccatttgacccagccatcccattactgggtatatatccaaaggactataaatcatgctgctataaagacacatgcacacctatgtttattgcggcactattcacaatagcaaagacttggagccaacccaaatgcctaacaatgatagactggattaagaaaatgtggcacatatacaccatggaccactatgcagccataaaaaatgatgagttcatgtcctttgtagggacatggatgaaattggaaatcatcattctcagtaaactatcgcaaggacaaaaaaccaaacaccgcatgttctcactcataggtgggaattgaacagtgagaacacgtggacacaggaaggggaacatcacactctggggactgttgtggggtggggggaggggggagggatagcattaggagatatacctaatgctaaatgacgagttaatgggtgcagcacatcagcatggcacatgtatacgtatgtaactaacctgcacattgtgcacgtgtaccctaaaacttaaagtataataataataaaataaaataaaaagaaagcataaaatatgtaaagctagtagagttatctggtagaccattcaaaaccatttaggccttgtctcatgacatgcaaaataaacaaacttagttcataatgggaattaactcactgcctcttcaggctgtcaaaacacagctattaaagttacaagacagctattaaagttacagggattacagtctcaatctaatgaatgaatgaatgaatgcatgaatttatttattttccccaagatggagtctcactctgtcacccaggctggagtgcagtggcgcaatctcggctcactgcaaccttcacctcccaggttcaagcaattctcctgcctcagcctcccaagtagctgggattacaggggtgcgccaccatgctcggctaattttttgtgtgtttttagtagagacggagtttcaccatgttgaccaggttggtctcgaactcctgacctcatgatctgcctgcgtaggcctcccaaagtagtgggattacaggcatgagccaccatgcctggcccactctaaatgaattttctaatcgttgataaccttgacatttttacttcagtcttgaaattttgatttttttggtttgttaaagacccatatgaatgctgaaaaaacaattagcctttcttttgcctgtaccctcacgtctctatatgctaaaaaattattttacacactcattcaattattggggcgttagtttttcattgtgaagtaaaagactagagtagttggagctaactttagatgaccttgtgggagagaactggaatagaattttgtagaggaatattatgcaagatgtggaagaattggccgtgttcactgacagaagaacaaagtagttctcagccattttacaagcatgacttattttattttattttattttattttattttattttattttattttattttattttattttattttgcagaccccatgtgttaaaaaaaatttaaggcttttgaactacatttctataataataataatttccctaatttttaattaatgatgtgtaaccactagtcagcaggagacaaccagtgttaccaaagtcagtttgtgcaatatatggtttctcttgccctttttgaattacccatagtggttctcaggccacactcctccagagttatctctatatactatcctggaaaatatgagtaataatatcttcatcttttattttataatttggaaaaaattaaatgacagaaagaaatggagaataatgtaagaagcagacatggaccaacacttcaaattgataaatattaagatatggtcatatttgcatcagaacttttttataaagttgtttgtatttctgctcaggccccttcctcagaggcatgcatgagcattggcatgtatccttttggttgatatttatatactttgctatacatatatgcagaaacaatatattttacttctcaattttagtcaacaatgaaacatcatggagtttaaacagaaggatgtgggattatgataggataattaaagtggttcagaagtttgatatagtagtcatatcagaccctgcttgaaactccttgatggcttgctcattagcctcaggataaaactcatattatttaacagactttcaaggcaacacattattagatttccaaagttttccctcttcagttcatctctccatatttctctttcatatctcatgcccttgttgctctgtatgcctcagccataggaccttttaagtttttaaaattttcagtctctaaagctgtattagtccattcttgcataggtttaaagagctacctgagtctgggtaatttataaagaaaagaggtttaattgactcaaagttctgcaggctgtacaggaagcatggctgggagacctcaggaaactcacaatcatggcagaaggtgaaagggaagcaggcacatcttacatggccagagaaggacaaagagagagcaagggggaggtactacatacctttcaacaaccagatctcgtgagaactcactcactatcacaagaacagcaagggggaaacacacctccatgatttaatcacatcccaccaggcacctcctccaacactggggatcacaatttgacatgagttttgggtggggacacaagtccaaaccatatccaaagcctttccacatatttgttttgcccagtacaattcttccaactttagttcctctcatccttccaacctcaatttacacatcacttcctctgggaagttcctctgatccttccaaaatatgacaccagagcccaattaagacattttagaagcctcaaatactaaaagtcatataggttatatgactgttgccctaccaccatattattcacaataaacacaatattaagtgcaatgaagtctgaaatttcggtttcctaatagtgactattttgatgattttattctttgaggtattgagtatcatgttatttgacaaaatcaagttacttgtttgcttactgcacagcagtctgttcttaacccatcatggtgcttattaaataatcttattgtttttctgcacattttactagactgtaaacaatttgacggtaggaattatgtattgttcaacatcctatccccagaacaaggacaatgcctggaacatggatattgatcaataaatatttgttaaatgaaaaaatcaatgttaacctagtttctcatggtttacaattacttattcaaaagccttgccttctctaagtttattcttagagatgagcaattccgacctaaaaggacgtgaagatcaagttattcctgtgtgtcgcactcactgtataacagagtggatcttcagatgagggaaaacatgaatataaactatgtctaaaggtacatctgtttgtataatattttacaatttatgaagtattttcaaatataccatctcatttggtctttataatacacttgggaggcagatatttttgtctaagtttcagatataaggtagcaggctgggacaggttaaatgacctgcaaagttatgtggcagtaaggcaggactagaactcaagtccacatcttttgactctaaataacctctctatatggaaacctgtggatcagtttatctatggctatagagcaatatagttctttctgtcactgaaaattcctaacctgaatgcttattcatgatgatcaaagtaaagcaatagtgcaattagaatatatcttccaactgactggtaaatcaatggattttatatttcaaaggaaaaaaagtaatcttagtatttttctctcttacatatcttctagagcctttacaaacctgagagtgtctatatactcattcttactactttctgagtttttggcatcgataatgttctaggtttttatagtgagataaaagtgttaaagtattggatttgagtctcagaaaacatgaaaatccaactatttttattttattattaaacaaacatattaatgattttatgtgacatttttgcataaagcttctacagagtcttctttctatggtttcagtatgtaaccaataagtcatttttatgtaaagatgtttgctttacccaagagattgtaaatgaaacttttatacccaaagccattctgtaatgaagattaccttatgtaacagattgaatgaaagcaagtcagaaataaatctttgtagaaaaccttattgacaaaattctccctcattcttttttaatccccttaaatcatattgccaccagagagattgatgtcagtggcatatttgatcataacactcttctgcttataccccttcaggggtacccccttagtgtacaagataaattttaagttctttcaaaatggtcaagtaccagcctatttcatcagcctcatttcacttcttcttgctttacaattcatattctagtaagaacaaactatgtttagctccctgcataaatctggttctcagccctatgcctttttaatcatgctattccccttgtcttgactattcctcagcttttatctggataactcctgtttattcctccagattctactcatgcttctctttaaaataaatgcctttctcagactgcttacctaggtggtagtctttccttccttaacaccctctactcatgtctttctttacagctactaatttatatttttccagctctattgaggtgtgattgacacattaaaattgtacatatttaagacatacaacatgatgctttgatgtatgtacacattatgaaataattaccacaaacaagctaattaacatattcatcacctcacatagtttcctgtgtatgtgtgtgtgtctctgtgaggtaagagcacttgaaatctactctcttagcaaatgtcaagcatgcaatacattattattgactactgtcaccatgctgtacattaggtctccagaactattcatcttatgactgaaagtttgtgccctttgaccattatctcctcccaccctgtccattgtaaccaccattctactctctgttactgtgagtttgacttcgttttttagatttcatatataaatgagatcacacagtatttgtctttctatgtctggcttatttcatttagcatgatgtcctcttggttcatccatgttgttgcaagtgggagaatatccttctttttaaaggaagattaatatttcattgtgtgtgtgtatgtgtgtatcacattttctgtatccattcatcttatgtagtacacttagattgtttctatatcttggctactgtgagtaatgctgcaatgggaaaccagacatcttttcaatatagtgattttatttcccttggatatatactcagaagtgggattgctggataatatagtcgttctatttttaatttttttgagaaacctccatactgttttccatagtgactgtaccaatttacgtttccaccaacagcagacaagaattctcttctctacgtttttgccattacttcttatcttttgacattttgattatagccattctaacaggagtgagatgatatctcattgtggttttgctttgcatttttctgataattagcaattttgaacattttttcatatacctaatggccatttgtatgttgtttttgggaaaatatctagtcaggtcctttgcccagtttttaatcaggttatttgtttctatttttgctgttgagttgtgtgggttccttacatattttggatattaaccccttattggatacatggtttgcaaatattttctcccattctgtaggttgccttttcattttgttgattctttcttttgctgtgcagaaactttttgggttgatgtagtcctgcttgtttatttttgcttttattgcctgtgactacaaatttatattgtactatatacacatttttgcgatttttctttcctgctaccctttgagctctttgcatcttctttccttgggaattttatttcggtatttttctacccttgtatcttttggatggtctgtgcatatttttctctagaccactaagtaaaataacatataacttggcataatctattggtaagaagtcaataatcaataaacaccatgccaagaatagaacatttcattattcttttgtagttaggtaagacgcattgatattttttgttaaacatcattgtatgatacatcatgatattgattaatgtattttagcgattcaagcacataacgcatttcaaaggtaatgataatctgtaaatgtgtgcagatacaagtataccagtgtatgtggtaggtggaaaattactacagttgtgggtatggagacactgcaagtacagaattatggaatcagggccttgttcacttggaaggaaacttaggagtcatcttaattcagctgcttttgaaatttgtgtgtggatcatgataataacagctaacatttgcatgttttgtaatttacaaaacatttccatatcacttgatgttcataggcagttcaacagagttgttattgttatgatgctcttgacaactctacaaagagaattggtttcattgtactgtgctgctattgtagatttcataatagactggaatctgctgtttgctgaaggaataagaagggatacatcttgttagtacaactgaatccctccatgttttcttccagatgtggcctttactgttatttgtttggaatttttgttaaatggcttcctgttttgtaactgttgggtggactgtagtatatttctctagacctgcactgcatctaacaccacagtaaccactagctgcatttggatattgaaatgtaaatttaaatcaattaaaattaagtaaattcgattcctcatttgcatgagccacatttcaagtgctcaataaccacgtgtttctaatggttatcaaattgaacagaatagacaaagaacatttttgttatcccagaaagttttattggacagtgctactctagaccattgctatatgtatgcatcttgatgaagttgtcatctgtcagtagttaagctgggatgctgtaaggcagaaatctgtaaaagtaatcagactgacaataagtggtaaatggatgaggattgttctagcttattactaaaaatggaatagtccctctcccctatggaaaagttgttagaaacttttttgaatgtaaaagactgtaaaatgacttaaaactagtgaaaaactgaagttttgctttcttttttaacttttaagatcagaggtacaagttaacatttgtcacatagtgtatgtgtcatgggggtttgttgtatagattatttcgtcacccgggtattaagcctagtacccattagttattttttctttttctctccctcttcccaccctccaccttccaataggccccagtttctgttattcccctctatgtgtccatgtgttctcatcatttagctcccacttaaagtaaaaacatgtggtatttggttttctgttcctgtgttagttttctttttacaaaataaattttgcttttgttgttcttcagctcattgtggccaatactatatcacagtatctttttcctctgaggaataagcagctcatgtcaacattttctactcctgacaatattcttcatcctttttttttttttttttttttgagacggaattttgctgttgtccaccaggctggagtgcagtgtcacaatctcagctcactgcaatgcccgcctcctgggttcaagtgattctcctgcctcagcctcccaagtagctgggattacaggtgtgcactaccaccacccggctactttttgtatttttggtagagacagggtttcaccatgttggccaagctggtctcgaacttctgacctcaagtgattcacccgcctcggcctcccagagtgctgggattacaggcgtgagccaccaagccaggctatccttaagcttcaccagatttgtgcctccttgcccctggttgataaatttgccacatttgttatactgttttaagaagatggaaagtattagatatattcttgattcatttatttttccctttaatatcacacttcagtcagctagtctcctttcttcatatttgtcatgtcaactcctccaatgatgcgttctgcttggtgtgtatatagtactagatcttccatctcctaatacactctcccaacaaaaatgacaagaatcatgttatatagagcatacttatatattctttgcatttataatctttacatcagctgagttatataaatatgtttatctggatttttgtaaattactgtatcatgataaatgctaaactgcctatcttctttttttcatcactttgaccctgcttctcaaaaaactatgcttatagttcctttcctactttgaaatatttcttagaagaccagtttatataagtactcttacttgtacatctaaactcctcacattgtctttttcaactactccatctccattattaaattaaaactgatttttaaagcttcttgctgtcatttttctctgactcttacttaaattagacactgtttttcccttctccctttccaaaactcttttcttgtctctgtaatatcactttcttcatttaatcctggccatgggattaattcttgctctggctcctaaacaagcattgtctgaggttttatcctcagccgtcttcccaccatacatactctgttctggtgaagtcatcattgttgttttcttgtagctttaactatcccttcaatgtcagtatcttcaagatctggctctgtttccattctaattcagttttatcaaatgcttgccagacaattgtatgtaacacgttctgttttcagccgcttctaattttatgtgcacaaaataaaattgttttaatctcctcgatttcctttctccatctctactataccattcatccatccatttcctcaggcttgaacacttagagtaatgtttaacttttccttctccattatttcttgtttattaatttgcatatttcaaattttttgtggatacgtagtaagcatatatattatggaatacatgagatgtttgatgcaggcatgcaatgtattcataatcacatcatggaaaatgaggtatgcatcccctcaagaatttatctttcatgctataatccaattatactttttaagttatttttaagtgtacaattaaattattattgactatagtcacactgttgtgctatcaaatactagatcttattaattgtttctaactgtatattttttgtacccatccccacttctcctccacccccactgctatatttcccagcctctggtaaccatctttctactctctatcttcataggctcaattattttgatttttagatcctgcaaatgagtgagaacctgcagtgcttgtctttaggtgcctggcctgtttcacttaacataatgatctctagatccatagatgctgttgcaaatgactgaatctcatttttaatggctgaatagtactccattgtactacattttctttatccatttatctgttggtagacacaggttgcttcaaaatcttggctattgtgaacagagctgcaaaaaacatgaaagtgcagatatctttttaatatcctgatttcctttccttgggtatatacccagaagttggattgctggattatgtcacagctgtatttttagttttttaaggaacctccaaactgtactccatcgtgattgtactaatatacattcccaccaacagcgtacaaggttcccttttctccacatcctcaccagcatttgttattgtctgtcttttggatataagccattttaactggggtgagatgctatgtcattttagttttgctttacatttttttgatgatcaatgatgttgaatacctttgcatatgcctgatggccatttgtatgtcttcttttgaaaactgtctattcaaatcttttgcccattttttaatcagattattagatttttttttctatagcattgtttgagctccttacagattctggttattaattgcttgtcagatgggtagtttgcaaatattttctcccatgttgtggcttgtctcttcactttgttgattgtttcctttgctgtacagaagctttttaacttgatgtgatcccatttgtccatttttgctttggttgcatgtgattgtggggtaatactcaagaaatctttcccaagaccaatgtcatggagagtttccacaatgtttcctggcagtagtttcataggttgaggtcttagatttaagtctttaatccatttttatttgaattttgtatatggcgggagatacaggtctagtttcattctaatgcccatggatatccagttttcccagcaccatttattagagagactgtactttctgcagtgtatatccttggcacctttgttgaaaatgagttcactgtaggtgtgtggatttgtttctgggttgtctgctctgtttttactggactctgtgtctgtttttatgccagtaccatgctgttttaaatactctatctcagtagtataatttcaagtcaggtgttgtgattcctccagttgtgttctttttgcttaggatagctttggctattcttttgtggttccgtatacattttaggattttttttctattttttctatttctgtgaagaatgtcattggtattttgatagggattgcattgaatctgtagattgcttaggtagtgtggacattttcagaatattgattaatccaagaacaagcaatatcttttcattttttggtggcttcttccatttcttttatcagtgttttgtagtttccattacagagatctttcacttctttgattatgttaatttctagatatttaattttatttgtggctattgaaaatgggattatttttgttttctttttcaaatttttcaccgttggtatgtagaaatgctactgatttttgtatgttgattttatatcctgtatgtttgactaaacttgatcatcaattctaatagttttttcttggagtctttagatttttcccaatttaagatcattatcatctgcaagcagtggtaatttgacttcttccttcccaatttggatacactttatttatttctgttgcctaattgctctggctaggacttccagtactatgttgaatagcagtggtgaaagtgggcatccttgtgttctagatcatagaagaaaggctttcagttcttcccgattatgatattagctgtgagtctatcatacatggcttttattatgttgaggtatctttcttctatacccagtatttttttttttttttttgagacagactctcactctgtcgcccaggttggagtacggtgacgtgatctcagctcactgcaacctctgcctcctgggttcaagtgattctcctgcctcaccctcccaagtagctgggactacaggggcgtgccaccacacccggctaattttttagtagagatggggtttcactggtgttagccaggatggtctcgatctcctgaccttgtgatccgcccgcctcggcctcccaaagtgctgagattacaggcatgagccaccgagtccggctctatacccagtcttttgagggtttttattatgaagggatgttgaattgtatcaaattctttttcagcatcaattgaaatgatcctttgatttttgcccatcattcttttggtatgatgtatcacactgactgatttttgtatgttgaaccatccttgcaacccaggaataaatgacacttggtcatgatgaatgaccttattaatatattgtggaatttggtttgctagtattttgttgaggatttttacatcagtattcatcagatattggcctgtagttttctttctttggtgtgtctttgtctggttttggtaccagggtaatattggccttgtagaataagtttgagtgctccctcccctgccccctctattttttggcatagattgagtaggattggtatttgttctttaatgtttggtagaattcagcagtgaagccattatgtccccagctttcctttttgggagactttttattatggcttcgatctcattgcttgttattggcctcctcaggttttagatttcttcatggttaaattttggcaggttgtgtgtgtctaggaatttatctatgattttccaatttattgccatggatggatatcgctgctgctagttattcagggcccaagagcttttcagttagcaggtgatgcatgctacctggactgggtccttccccttaaggcaacaggttcccttttgacccagagtgcatctagaaatgtctatcaggagctagggcctggaaagggggcctgaggactctgactggtaccctatcctgctgtggctgagctggtatcccaagacgcaaacaaagtcttccccactcttccatttcctctccccaagtgaaaggaaggggccttctttggagccacgagctatgcaacctggggttaggggagggttgatgccggtgctcccttagccatcccagctggtatctcagtaagttgtgtgccgcccccctagtccactgtctctgggcccagcttagcactaggacttgcctaagagttgctgtccttgtggcctagacggcttttgcagtttatttggggccccacatcgctgtagcccatggtggcgaagcttgtggaaactcaagttcagatggctgggattggtgattgattcccctctggttaggactcgtttaaatgctccctccatgggtgaacatcagctgaatttggttcagttttgttttctgctataacaacgtcagagctgagtttaatgcctcagaattactggctttctttctccccagtgcacagaaacactctcatcatcaggcagctgctgcccaggtttgggggaaagggggcattggcaattgaagactgtttttcctacctcttctgtgcctctttcaatgatatgaagttaaaactaggtattgtgagtactcacctgatttttggttcttatggagatgtttttttctgtggagatagttgttaaatcggctggggggacaatccctcctccaccctttctagagataaaacatccactttagtatgtctaggaagatacacaactttgcggagattcccataactgagatatggcacaaaaattactcttaaggggctatgaagaatggaacaagagatgactatgggagttgttagctggacaagaacatttcatctctacagacccctcaaccctcactcacaactcacattgctgtatatcatcaactattatattagataggctgccttgacttcaactcttccccaaggaaagtcaagagaaattataaactgactgagttaagtttttgaaagagattcaaaatggaaattaaattgttatagaaaaattgaaattgcttttcttttaaaacaaaaacaaaaattttcttcaacctaacattggtagctctccataatatgccccatattattttctctgccttctttcccactgcattttccccacatagcttaaattttaaccaaatcagtctgcttacttcttattgactgtgcatttgttcagtgtgttcacacactttgaaatgttctttctccctaaaccttcaaattccagatttgaaagccatttagggccaggtaaaatatcatttccttcacttagttaatccaggattatcagaatttatctcctttttaatgggatcttttgttagaatttatcttatctaccttctatttgtatttgaatgttttctcccctcctacttaatgaaattgtgatggccaaataccaagggtaatttatccctcattacataatagtatctggaactgaattgcatttagatgacaaaaaacatgttggtgaactgaattgtgacttcaataaataaatgaatgcaaggaagagaggaaggcagggagggaggagaaaaaaaaggaaaggaaaagtataatattcattgcttaaattaaccccttaggcatgtaaagacattttgataataatagaatatgttgaagtgttgagtatgaaggtaccattatcaaaggtttacatagatggattatttatatattacttctaagtaaaacaatatttttatattatttgtaaaagtatacaatatatacacaaaaataagacatatggaaatttatggcatttataaagttccatgaaatataatagtattattattagagatatacactatttcccttcactatctctctttatatatttactattaataacatatgcactgttcttatgattataatatacaattgatgagaaatattacttgttctgagcattgtgacccaccaggcgcttaaaacttgttgacaaagtatggagcatcagtggtaatatgtaggagtaaaaattgttctgttattctgctcagtatagcaattgcatcattgtttcacagaaaggataacattatgatcctgtgtgggtgtatagctcatctgtgggaggatgtttctgtgcatacttagtgatcaaaattcaagaaacacgcctcatttttatgaatattttctcattaggaatttggctcatgtaaatgcatcacataatttgtagaagcattatatggaaaaggaaaaagaagaaatgaattttttttgcatatacaataaaagcttgagctactgaagagaattcctggtagtatatagtatcgtgactggaaacccagtctttaaaaactaaatttaattctaacctaaaaataactggaatgtcagaggtgtacctttccacagcatgaataggtttgtaaagtatagatttatccatatgcaatgctattttctctttaaaacttgagatatcttttgggaaaggatttggccccaagtattaataaaacccatactttagaagcaagtattttaaaatcacctgttgatggaagtaaaataacttagtaataaataaacccccccaaagtacctagagctatttaaatacttaacatgatgaaatgaatgccataaaattacagcttaacaaaatataacatagtcatttagtttctattcttctccctaatataaagtagcaggttaatatgcattctctctgtttggttttgttgttcttttttttgttttgaggcagagtctcactctgtcacccaggctggagtgcagtggtgcaatcttggctcactgcaacctctacctcccagattcaagcgattctcctacctcagccttccgagtagctgggattacaggcatgtgccaccacacccagctaatttttgtatttttagtagagacggggtttcaccatgttggccaggctggtcttgaactcctgtcctcaagcgatccgcccacctaggcctcccaaagtgctaggattataggcatgaaccactgtgcctggcttctatttttaatatgctgcatcctcaccctttgtggaaagcctctgggtttcaataactagcaagccgatcttgctgaaagaaggtagagatacaaacaagtagaagcaactgttccacataaagaaagaaataagtttaatgggaaaaaataatgaattgggggaacgtgcaatcaaaatacaattctgaggatctcagaactatttggagtgagctggcagataatgttataaaaagcaggttaccagtttatggattctatatatttgataattttgggatagctttggtgttcctgtatcacatggtaatcctataaaatagatcaagtgtttctcgaaataccatctttataaatatcatcttggaggcctcactctgaatcaactagatccgtacttctgggaatctgcattttaacccacccctcaaatgattcttatatatgcagaagtaaaatctgaaaattactatagtagcttaactgagtgtggttacattgcttttgtgatgatgccattattttctctttctaaagacccactgtttccaagacccagttaaaagccacctttcttgatttgttttaacacagagtttagtttcttcctcctctgctcctctagctcccataattgtgcctttgttacactaatcaagagtatcccaaatctcttaatgcagatttaaactttaataactttacatacgtaagtgctacaaccttaccaaaaacattatttaaaatttatttaaatttattttacaatcatttagttttgtttattttaaatagtaagttcttaattttaatatttatatgtggcatttttttggactggtagaaaaacttgaccacctcaatcacctcatatatctcccttaaactttcttttgcagggtcatgtcaaaatagttgagtgtgcaccaatattttattcttcaaataatcttaaatctaggatcacagatgtcatcctttctgtcactaacccacagctggtagaagtttttgaaaagtttgaaatttgactagagcaatgtatagtacaacccagtatactatatgttgaattttatttcctgttgaatgttaataaaaatatattaatatcttaaaattttaaataattggccttttatctattgatttgtgtaatggtgtatcatttatacttctaaagttaaaaatacttaaaacagcatgaatactttgaaattctgtgttttaacttatttgtgtgaattcctatctccctaaacagcacttctctaagtcaggggccatgttttattcatccttttgtctctagtacagttgattaatatttgctgaatcaaggggaaaaatatgtctattttatattgtctaattaatttagtatattcaatattatttaaatattactaactatatttagatataggtagcacatttaaaatgtaatattaatatagcatcaaacatatatttaatagtatttgttgtgtttccatccattgcagttattatccttttagatgctcaaattgttccatgtttgactagggggaatctcttcatgttgagtcctgagtcctactaaaacaggagccaactcctgtgtagtggtagtcttgacagattactcctagtagtctttgataacttccttctgtcttgtatcacagtataatccaagctcatcttgtacgtttcctattccagatctcaaatcagccattttccaagaaggcttggaaatgtggttttaagaccataaagtctgggaagtgtatcattactaggttggtcattgttcctatgccttttcagggtgcagtgctaataaatacatgcatacatgtatatacatatgtacatagataatacttcaagagactccagcatattatttaacttcttcaatcttatatatgtgtctgctttatcccatgctaaaaatacttatcaatgacactggagtgatagaatggcagtcacataattgttcagttattcatcttataaagcacacacagcagattctgcatgacaataataatcacaacactaccatctaacatcatatgattactgaaaacagtttaagattattttaacagttctttttgttggatcacattaggaatgtgctagtaaatttttatattttaaagatacttgaaatagttactttccgtatgattattatccactactagagtatacattcagatcatgtttactttgtttacttttttccttgaggagaatccctttgaagtttgaatttttagtcataccctctgattctgggaaggtaggcaaataatggaatttgcatacattgcagctgaagcaagctgtagaagcagcatgtggaagctgggcaagttcccaacttttcccagattatctctcctttggcatatgagtccctcagaaagacaagacccaattcttaagtatttctgtgaattttgtaaaatatacttaagttttatttttaaaactttgccccgatctgcatatgtatttcttctgacaaggcattgtggtgaagttgcattatcaaaaattgtgttgaacaacattccttttttgttaaaattaaattcaggaaaaaatgaaatggagtatcatttcttaaaatattcagtactgtggaaatgggtttgttttttttttcaaaattatccaaataataattaattttattttttgaagtaaagttagttttttaaagttaaaatagcaatggccaggcgcagtggctcacgcctgtaatcccagcactttgatctgccgaggcgggcagatcatctgaggttgggagtttgagaccagcctgaccaacatggagaaaccccatctctactaaaaatatgaaaaattagccgggcatggtggcacatgcctgtaatcccagctactagggaggctgaggcaggagaatcacttgaacccagggggtggaggttgcagtgagccgagatcacaccactgcactccagcctgggcaacaagagcaaaactgtctcaaaaaaagtaaataaataaaatagtgacattaatacatggttaaaatgtatttatcacttaatgtatgtcagattctaatgacttatctcattttgtcacttaattctcacagcatttttattgggttgctaccagtatgcccgttttataaattttgtgaggaaactgcgccatagaaacattgtctctaagcaaagatcagtttgttgtattactgcttattgtatatcaagtaattgcaggttaaaagaaaagaccatggtggtttttgaaagaattttttgtaatttctgggacttaaatttaggtgagaactatgaacttggtaattattattagtagatgtattaattttaagtgtgtactgtaaagtatatttaatagcttgcaatagttgaaaatataaaagtatttgagattttgataggactattgaaataaatgttagtgtgttttttaatgttctaatctataataaattagtatttgaaatgttagggacatttcaacagaatacatttatcacgtgtaaaagcttagatagaaaatggttacaatattttttcaatatttgtttttaaaagtctacttaatgtatattgtcctttagtatgtgtttaaaagaagtaaagttagaatatacagttaagcaaaaataaggatagcctctgttactgaccatcagagctaaccattattaatattttggtatgtagcatcctagatttttcctgttattattgcttttacttgaattgttaagacttttaaaattatagtataatttctaagaaaatatttttaaaagaatgcttgatattttgaatctaatgtatatggttcttttttttcaggattgtactgtatatgaaacagagaataaaattcttcacgtggtgagtatacttggatttattttaatctttattagaggatatttccttgttcaactagaagaggtgaaccataagaaaaaaaatctactgaccacatcagttaagtgtatttttataggaaatctacaaaacaatcaaagcataacaagttacgttagttataaccattctattgtacctaataggagaaaaaaggtataatattttaaaattgtaatgtgtagcaaggttggaatataataaaaaattaataatgtagagcaaggagaatttgaaatgagaatttcttttactgttcatctattacaaaaaagatcagagaaaggtattctgttctataatgggtaattcatctctatcatcatttggatgaaatactttattaaaaaaatcaaatttcctttgctccaattctatacctacgagacaacctttcaaatggtaatatggcaatatttttgaatcagttaatgactttacatatattttattactagaaatgggctacgcgtacattatactttgtggaaaggccatctcctgccttcttaatgaacagttggccacttttatttgtaaatgcatttcttgatcaatgctagtttgtcctaataacttcttcacctctggtgtgtgtgaaatcatgtcatttctgcatctgccaggtactaggcggtgaagatccatatgtctgtaaaaggacatttgcctcatttattcctaatatcagtctattaagttttatgtttctgaaatgtttgaatatttataaaagaatactattttgtatttagaaaaggaaatacttttaaaacatctaaacgtatggagggaaaatattacttcagaatatcagcagtacagcatccctattccttttttgttatctgttatagaaatgatactgaataatcctctgctaatcctctccccctcattgtgcagtagtgatgccctttgtggtttataagaatagtctcaggagtggataattaatttacttttctccttattagtccaggagggaaaataattacaactccctcacgttgatctacctgtagggcctggagaatagaaagacactaatatttatttagggcctatatatttcaagtattagcttaatttcttataagcatattctctcatttaatcctacttttgcagatggtggaactaagggtcacaaatattaagttgttcaactattcggtttgaacacagaatctaataccaaagcccatgccctttccagatctggcagttgctaccaattctagctccctgaggctttacaaattgtactatcttttttcccgtggaacccagggctactgtctagctgtgcctattttgtcaataactaaggagcatgcacagaccctttcccacctacattttattttctgtgagtgactgtttctttagcattgaattttctatgacaatgactgttctttctgaagtattgaatttactgaattcgactttggtatgctgctgtgggttcttcattgtgtttacttcaaggctgttattgaggtcagtgtgtgttaacatttttttctttatcaagtttctcaggagtaatctccctgatgttagtatcaaaaagagctgtacttttcttcatgcattggctgctacgaacttaagattaaaatttgtggcccataattgacaagtgcatctcatggtatttgttttgtatttagcttcattcttggctctacatgatttctttttgccttgtttttctcaatttatgtatggtatatatttttacatctgttgatgtagccttttctatggaggaatagttccagttacaaatgcacatttgtgatcaatattcaaatatcaacaaaggaaatgtaaataatttatggaaaaagaatctctagagaactgtaaaaaatatgaaattttatttctgaggaaatttcagattctaccatatgacagaataacagaaatagatttaaatgatgaaagaaatactgtgggatttctcttgtacaaaagactttaaatataattttaattaattagactaaggaaataatctctttggggttataaaatgatgaatgaaattttattaaataaaaaccataataagtaatagccaaattttaaaagttcttaatcactaaatatttttaattttaaataattttaaaataataagtaatttttagtttcttaaataaattcctaataattgactcatattgactttatctttctcaaaagccagattctgggctacttgctattagaaataagtaacagcataaatagtactgaaggagtttagaaatgaatgccgtatatttaccttggcaattttgcattccagctagtgagaatttaaaaatcctgtctgatgatgatgacaacagtgaatggcattaaccaaatcagttcatctcagaaagcacttgtcttttcatgttattcttctacttcccatcctgacgtttttatacaaagattacccagcctttaccaaaaggttgtatgtatacttgtatattacttttttcacaagaataattttttagaataataaaatagtatacagtaccacttagtatatgaggctagaatagtttctttaaaacaaaatttctagaataagtatctttctagatctctatagtgtagaagaaataactttgagtctaaaaaactgtctgaatcctaattctaccattttctatctcggtgagctgaatcaagtgatgtttttgagagtttgttcttattatgtaaaatggggatattaatatctttcatgaatgattgttgctaggataaaataaatcagtaagttttctagacagagctttataatctggtagttctctttccagtatttattttttaggttatatctcattatttaggttttttgttgttgttggtttggtttttttttttttttttttgagacagagtctcgctctgtcacccaggctggagtacagtagtgcgatcttggctcactgcaagctccatctcccgggttcacgccattcccctgcctcagcctcccgagtagctgggactacaggtgcccaccaccacgcccggctaattttttttgtattttttagtagagacggggtttcaccgtgttagccaggatggtctcaatctcctgacctcgtgatccacccacctcggcctcccaaagtgctgggattacaggagtgagccactgtgcctggcctatttagggtttttaatatcttctttctctcctttttatatggaccagtaaatcaaaagccagagtttttatatagcttgtttaggatgcaattgtgagttagttttaatgttttccttgtttctatgatacttgaatattctaagtacaatatgatttataatggctccttttcaaagatgaattaatatgtattgtatatgagcatcttagcctgggttctttctggaaaacagagcctacaacaaggctcgaatgcagatagtttgtgttgattagttatcccaagactcagaagagacactgggaaggagaatcaatatgggttctagaattgttcaccactatagggaactgaagttcgatcccatcgggaccttctgagaagccctgcagaatttgccttggaattgtccaacctgcctgacaaaaactgaagagggagaatgtatctgctggctctaatccaattatcccattggtcaaagcttgctccttggggtgttaactctctcacactaccaggtttttggaggtaccagagagctctaggacagaaagcaaaggtagtgcaactgaagtgaagcagattgccacagcagtagctggagaaaaaagtgggctgagtgggtatgagatggggcttaaggggtgtctggtataatgaaacgcctctaagtggcaatccaaattttaaagtattttggatcacataaagtatcctgatagtgactgaaatcaagatttgcataactcacaaaagcaagcttcaaacagtagacataacataacttttgtgtaaaaaagcagtgtatttatagtgaagaaaataatttcaagaactatgcaacagacttaatgttggttgtctttgcaaggaataggataaattttagaggcattaactttaaattatgtgtttgtataatggttaaatatagcataacaaatatgtgttaatcagaaaaaagtagtactaaaatatccatagaaatgcctgaatagcaacccaaaatctagattaaaaatgagtattttattgttagatacaatgaattagatctactacttgatagcacaacagagtgactacagtcagcaataatttgttgtacattttagagtaactgacggagtattactggaatgttcataacacaaagaaatgataaatgcttgaagtgatggatacccccatttaccctgatgtaattattcacattgtatgcctgtatccaaatatctaatgtactccataaatacctaatgtatacctactatgtactcaaattttttctaaaaaataagtatttttaacaaatgagtaagagtttcaaatgggtaaggagtgaaaacagtgccagtagccaaccattgactaacctaaagaacatggctgaaatctttctaatgccaggcagatttagaatcctatgtaatatattaatagttcttaggaaccttttcactttagtacactggactgtgagttaaataggtttttagaacatccccagtgatggctgccatttagaaggaacaaggagaccccagatgactgaatagagattatagtagcttgagataggcgctagaacatcaactgtcttagcctaaaccctacccctaaatctttattttgtccagaggatagggaaggcagttttcaagaggaaggagaacttatcacttatgaaaacttgttatagcctaggaattccacaaggcaatacaggttgattgtcccttatctgaaatgcttgagattagaagtgtctcggatttcggatttttttggatttgggaatatttgcatgatatacttaacagttgtcactaatctgaaaatactaaaccaaaatgctccaatgagtgtttcctttgagcatcatgtcagtgctcaaaaagtttctgattttcggattagagatactcaacctgtacgagtgtcagagtgcccttcaacacatgggcaaactgagagagctgaggttgtgaggtggtgtatctttccctgaaatagatctgtatttaaggatgggtaaagaaaaagaatgggtaagaggagaggaagtatcctctaatatattagaagaaaatccttccacatgaagtaggtttattatgaacacttgtttaatgttttcagttgagccaaaagatattacctgtattaaaaaagaataccatactataaagaaggtaaggtcactataaactgagagcaaagtgaactaagaaaatagtacattaaactaacatggaagcagaaaataaaccatggagaaagcatgtatcttcccaatttttttcaattaatttgcatttctttcataatgaaaaagtataaaagtatgtatttattatagtatagttagaattctgattgcttataatggatgattttatagtacatatattgaactagtcagaagggacttggacaatcctcaggctacattttctgttcacttttctcacctctaaaattggagagagtctttctgcttaaaatcagaaagaagtaggctgtgaggaccaaaatccctggtgggaagggagattggttgcagtgttgggcagggatgtctgttaatatgaagtgtgagaatgaataaaaggagactgaacatcttgggtttcctttgaatttgccattaagtataatggaacagacaatagaatacaaccataaaggacaaaaggcaatacagataatcaatatagtatatatctcagtgattatcgactaaagataaataatattatgtttcacttctattgatctgatcttttccttccagttagtttttgttctggattacacattctctggcaggttagagcccatctgttttgctctgtgcagatccttgttttatataacaaatgagttacagagaatctggaattttcagttctatactctacttactcctcactcctgcctttcagtacacccattgagtctggagtgataagctctcctgagaagtcatttcagagcttgtgctttagcagacttcctctgcttgtccctgccctgccattctcattggtgagcctggaacacttgtcggctttgattaaactcatggaaatcccaggccaggcgtaatcattaaggtcacattgtttaaatcagattgttctgagctcacaaacaccttttacattagccaaaggtatggccttgtatatggcactttgtattttagcattttaccccattgcttttgtaaagataataaatactgcaaatgcctattttattattttagtgttaatattatcttctagttatatagtactttacagtttacagaacattctcaggaatgctttcttctcttttttctctttttttttctccaagctatttttttcttttgttacttaggtttgatcatgaattaggcttattttggcatgttaagtatttgttttatttcataaacattctttgtaattttttcctttctttaaatttatgaattccttgcccttaaactccatctggagtgagattattatgtcttctctggtatccagactagaaatagcttaaactgcatagagccaacagttagatgtaagagaggatcctggaggagaaagtaaagggctcattttagtcttttccctgacatctacatcatatcatttatgaaagtatagctttcctcttctgatggatcaaaaccttgaggatgtgtttaagtactggtgtagcagcataccccaaagtgaaataaaagtgatcatattaatgttaatagcttatctttagagatttcttgaaaacaatggtactctagtgacttaaaaatccctgaagataattttaactcgtcttcaggaggtttctgatgctgtgatgaagcagcttttgccagttgtagcccagactcttctaaaagctatgatcttgatccaaatgcaaactgaattttttttcagtatggttgagattttgttggtaactgtagcatttgaacatataaattatggtcagtctcactaaaacatcaactctaatactgagttttatagatgaaaaacgtaagatgcttctttatgttttcgaagttaaggtcacccttctgtctcagccccctttattatctttgtggtcagcctgaagaaatgtgctaacaatattgctgaaataggcgttggattctttggtgtcatattatattattttcagattttgacactttggtggttaattgcattgtaaattattttaactataaattctccacaactgatgcctcatgcaggaaaggaaaaatgagaaatccagatataacatgatagaggtggaaaatgtttgtctttcctgggacaaaaagaaaatgtgtgtggcctatgtgaagaattaaaataatctggttttagtgtttctgattatgatttaggtagacattttataaggcagtatatttatttatataggtgtttttgctaacattacatttgctgaacacattatgcattgcaagatgcttccatattcatactgactctgaaagtacaattcttgtcctcacagtagtattcatttttgttggggagtcaagtgaggtagaataatacagtagaaagagcagcaatctgagagttaaaaggataggtgtcctgaccccattctggcatttactagctgtaaagaagctaagttagcctttctgactaagttgagggcttggagtatctgtgacttttaaggtctaaatgccataattcttagatgacaaattcacaagatcattagaaagcagtatggccacataaagcgataaattgaagaactgtctttatttgagaccactgtatatatgaccaaggacactatatatttttaaaaataaagttagcaggcacatattcagttttgatacatgggcatattgcatagtggtgaagtctgggcttttagtgtagccatcacctgaatggcgtacattgtaaccattaagtcatttcttaccccttaccccctcctaccgttccactcttctaagtccccagtgtttatcatttcacattctatgtccacatgtatacactttttttaagctctcacttatacgtgagaacatgtggtatttgactttctgtttctgagttatttcacttaagataatggcctccagttccatccatgttgctgcagaagacatgattttatacttcttatggctcagtagtattccatggtgtgtgtatacacacacacacacagagacatatatgtacacacatatatatcacattttaatccagtctgttgatggacacttaacttatttagttccttatctttgctattgtgaattttgatataatatttgttttcctttgggtagatacccagtagtgagatagctggatcaatgctatatatttttttaaagtgcaattatagtcactgtcaatgtaaagatttcttccacaaggtaattgaatcagtctggaaacagaagccacacagtaacttaaaggaagtttgatataaataattataaattatgataagaaatacctgcaaacaggtaaagagcgccctaaaccatgtcctacaactgaggaatagtacccaaggaaggatatcttttaagtggaacacccttcccaaggctgagaaggtgtggctgcagcttcattgggttgcatagatcagagcttatccacagttgccaggcaagtggaagacaaccttcgaggatgtaggcaaatgatgctgctgggaaggttcacagcaagagttaggatgatgctgtgagtaagaggtctggagagcatgctgagatagcctcaggatggtgatcactgagcccaggctgaggctgcaatgtcactgtgggactgcatgatctggacatgtggctggggcacagcactaccgatatccccacacacatgcactgctagtggaccctgcaacaggaacaagaaaaaaataaaagaatgcccatgggaacctagaagccttcttctccttgcagtgtccctccactgccctctattgacaaaaacttaacattgtgcttactgtacaagataaatgcttagagtccaatccattgtcacagagcaagcactgaaggatgaattgagctgagagccacaaaactcataactgacacagtgtggttagctcttacctccataaaactacatatagctacttcacatttcttgactataagtgaagacatcgctcccaggtctctgccgtttggtccctatttatccataaagtgtatatatatagtgccttaaatttccagaagcttatctaattataatgaactgcttcactcttgctatttgaatataaaatccaagctaaaatcaaaacatttttctaataacctacatcttagttgagctatcaatatgtccagtctgttctttttcttgagcctgaaagtcatgtgtcctctaatgagtgatctctcatcttcttcggaacctgccacaagcctgcttgtctctgtttcctgcctatgaaacagcagataaatagaattgagattttcccagatccaattctggtttccagcttactctatttccctatcagaagtgagagtagtggtggagcctcttgtcccaactcttaattcataccagattgtttcaggtaagtagctgaaagtaggctcgaagtgtcatgggtgaacttcttactcatcaaaggtgtacatttgggactgacattttctcactgttttggcattgaccttatcattcttagatgattattatcttaaagtgtaatttttaggctgtattattatctcaatgttgggctcactaggcattaaaatatttgatatttacttgccaaacaatgttcaaagcacagtggttaagcacgcaggaactgaagcaaaactgcatgattgtaacttggctctgccatttaaaagttgagtgaccttgagcaagtttttaacatctttgtgcctccattcctacatctgtacaatagagataatagcagtatttccttcttagggaggttgtgggggttaaatttgttaatacatgtaaatgacttagaagaatacttagaatatagtaagctttcaataaatatcagttattgtttcatttagtcctcctcactatacagtgagatcggtattatttttgtcccaattgtatacataaggaaactgaggcacacaaaaggattaaacaactttccccagatcatggagctagtaagtggtgaagttactattcagtctgaggcttttaatcactatactatagctgactctgtagatgacctcgaaatctaattctaaggtcataaattatagacatttaatttcagtgactttcttttgtctttctattgataattttcctttggcattcatggtagacaggattctaagatgacccccaggacccctgtcccctggtatataactgccctcttcttcagtgtggttgagaccagggaatacaatgaatttcactctcatgattaggttttgatctatggcaaaggtgaaggaatttcaaggatgtatttaaggtctcttgtcagttgactttaatataattaaaagagagattatcttggtgggcctgaccttatcatgtgagccctttaaaacaagattcaaaggaggcagatattctcttgctggccttgaagaaatcagctgccatgttgtgagagggcctgtgtagggagtcacgcagtgaggacctgaggacagcctctgggagttgagaacaatctccagatgacagccaacaggaaagtggggacctcagtcatacagccacaaggaagtggattctgctgacaacctgaatgaacttgaaagcagattcttccctacttacacctccctgtaggaatacagccaagttgacagcttggtttctgccttgtgagaccggggactggttccagtgcctggactcctgagccatggaaactgagagaatgtgtgtttctttaagcctccaaccttgtagtaatttgttacacagctatagatacctaatacagtatcattaatttaaatttcaactcaagaagaacaaaaacaaaaaatgtattttttaaagccaaagagagactagtagccagcagagaataaatacgagaacaattcttttgagaatttaaatataaggtactatattgcctcctaacttatttgattcatgtcttatttattataaatacttttttgattagaggcaacaacatgtcattgtgaaaagaacatttgactaagcatcagcacttctgggttttagtcttgacttttccatgaactttgttgtgtgacacttaacctctcatggatccccgagtgtcattcaggaagattaaacaaaatgatttcaaatcatctgtctcaaaattctgtgaatataaggatttaagtaattagaagcttgtagtaacaggactaacactgtcaataagctttaggacctttaagttttaatgtgggaaaatgtaagaaattaggaggaaattatgcttttaagatcatgaattttgacttactaattttaacgcataataggctgttaggggtcattgcttcttttctgttatcaggaacacaagggcagcatgctcagtgtcagtgatggtaagcacaaaaccaaatacattagcagaaacactgtcccaggctatgaaattcttgagtgtagtagttggcgtttgaatcatgtaacagacacttagtgattgttgaaggcatgaatggcttaatgaaggctggtgatttttgttgtgtttttccccaccatgagagtttgacatgtaaagggattgtaggagttttccaggccttattgggatgaagttcacatgacctttatttacttgcaactatttgctttctcaagctatttgaaaatcttagtctttgctgtatataaatataattttaatattgggttaaaattggaattttattctattacattagtttttcaagtttaaaaagtttttctccttcaattctctgtactcgtatgaacaagaaattcttcctgtgttgcacgtatgtttattacggcattactcacaatagcaaagacttggaaccaacccaaatgtccaacagtgatagactggattaagaaaatgtggcatatgtacactatggaatactatgcagccataaaaaatgatgagttcacgtcctttgtagggacatggatgaagctggaaaccatcattctcagcaaactatcacaaggacaaaaaaccaaacactgcatgttctcactcatagatgggaattgaacaatcactcataggtgggaattgaacaatgagaacacttggacacaagaaggggaacatcacacactggggcctgttgtggggttgggggagcggggagggatagcattaggagatatacctaatgtaaatgacaagttaatgggtacagcacacgaacatggcacatgtatacatatgtaacaaacctgcacgttgtgtaaatgtaccctagaacttaaagtataataaaatatatatatatatatatatataaaagaaattcttcctgagttggagaatgtgtatatggaataataattttaaatactaatttaaattctgtttctgaatgttactctttcaaagttacctatgattgttcaacagttgtgtcttgttagggaaccatcataagagtgcaaaatttctagctcaacagaaatctgtcaagtactaagatactaaacatactatatttagtgaggcgtatacttacagttctcacaacttaatatcagaataaatgtatgatattttataaaaaacaaagcctcccttgttcccccagtacaatgcacatgtcatcctacattggcacagagttgcagaacttataatactgaattatactaatattcaaataaaacaataaaataaaaacatactggctgggtgcagtggcccatgcctgtaatcccagcactttgggaggccgaggcaggcaaatcacgaggtcaggagttcaagaccagcctggccaacatggtgaaaccccatctctactaaaaatacaaaaaattagctgggcgtagtggtgcgcacctgtagtcccagctacttgggaggctaaggcagaagaatcacttgcaccgaggagtcagaggctgcagtgagctgagattgcatcattgccctccagccctggcgacagagtgagacttcgtttcaaaacaaaacaaaacaaaacaaaacaaaacaaaacaaaaacccatactttattctttagacattttaattgaaatattatttatatcaataaatatttaaacatgtacacaactgtttatcaaaataaactttcattactattttccatgctattgataataagcctgaattgtttaaactgtatttaaattgtaactttcacatcattgttgccatcttaagatgtatatctatctgttgcttccttaatttatcttgattttatattttatactcttattccttgtatatacgtatatacccaaaaagtataaatttctttttgtaaagctttttttaaccttatcagccttgagttctttcctgcatcaaatgaattttctgactttttaaactaaagatatttttattcatttgttccagtatacttggaagaataattgaacagtaccccacttacttagaaaagcaaataaaaatactttaagtagctcaataatgcctaagtgtgcttccagactgacataagagttttttctgtcccttagctttttaccactgtttgcacttagaacactttctgcatttcttttttaaaaaaacaatagctggccaggcgtggtggctcacgcctgtaatcttagcactttgggaggccaaggcaggcgaatcatgaggtcaggagttcgagaccagccaggccaacatggtgaaaccccatctctactaaaaatacaaaaaattagcggggtgtagtggcaggtgcctgtaatcccagctactcgggaggctgaggcaggagaatagcttgaacccgggaggtggaggtggcagtgagccaagatcatgccactgcactccagcctgggcaacaaagtgagactctatctcaaaaaataataataataacaatagtagctaaaacttcatgtattaatcttaaaagtatctgataaattcagatataatgaaagaaatctattcagacataatgaaagaatgctatcttattattggttaatgtcttaatgtgggattattattttttgaatccccacattaaaatgttgctttattttgtgctaaatatgctctgctctgatctttttcccctttaaagcttatatttaggtaaaccagcgtgtatgtgtgtgtgtatatatatatgtatgtgtgtgtgcgtgtatgtgcagatagatagtatagaacagaatacaaaaactttgcatttcagcctgagaatatgatgtattatattcatatttgaaattaatataaactacctgagaaaaaaaacacacaataccataaaattcagcatatgacactcttcagttttaaaagattaagtcatggctacccttgtctgttattcagtcattaatcctttgtcaccttgggtagtttataacagaatccagaaagtcagttaaacatttatttccatttcatgttctctgtagcttttttaaggcatatcatttactattctttaattttaggtacaaatttttcttctatttttagaaataaagataaatataatttaaaatacctcgggggctgggtgcagtggctcacgcctgcaatcccagaactttgggaggccgaagtaggtggattacctaaggtcaggagttaaagaccagcctgaccaatatgatgaaaccccatctctactaaaaatacaaaaagtagccgggcgtggtggcgtgagcctgtagtcccagctgctcaggaggctgagacagaattgcttgaacccgggaggcggaggttgcagtgagccgccactgcactccagcctgggcaacagatcgagactccatctcaaaaataaaattaaaataaaataaaataatttgatatgaatattgcgaaaatagcaaataataacagtggttactagtcatcttctagctagtatagagttgtccttttgctggtaaaattgctctaagttttcccagacagccatgtctttcacagtctcagttctaatattccttatctaaactacattctaaattgcaagaacacttgcaagcctgccttatattttgttatactatgtagtttaaacatgttatataacatccatctaatgtagacattgattttaaacaatacaaaatgaaattgatcaaaaaaagtccagtgctaagcatagaaacagaattagcacaataatgattaggaattcaagtccttctgccatgctaatgaccttggtctatttagcctccttctcacatctgttaaactcgctataatacctactttaggaagttgttattaggataaacgagataataaatatgaagtatttagcattgtgccagacacatggtaggtgatctacaaattatagctaataataatgttgttgaattataataaaagggtatttttcttgctattttatgattttctttttctagaatatgcttaggtagtaatagataatattgtgttttaaaatataaattataataatataatgtctcacatgatttcacttaatgaatagcattgaccaaattcaggttttgtaagatacattaaataacttccctggaactttcctatagtgctgctaatgtggtttcctgcagtaacttgatgtatgatgcagtaatgagtatagaattagcatgtaaagcaagaccattttataccccttctaattgccttatttagttaagtgccaaatgctacaatataaagtttctagcgtattatctctaaaacaggaagcaaagttctaatggggtttcttttctaattctattttttaagacctttaatctgttaactcctgatagctttgctggtaaagtcaatgtgtttactcaccttttgtattcctagcagcacctagcacatagcaagcatttggcaaacaaaattactcaagaggaatctgagaagacgtttttgcaacttaatatgatgaatttaattggtattttcttttccctaaaatgtctacagtctggtatttctgcctttcctttttccactccagttctataaaactaccagtgcctgaataggagagctactgttgctcattacaagagtgttatatgaggccttgaatgttgtaagaaatatacatatgtatatatagacagagagccatttatatacatccattactttcctatttatgtattggactcttttgaaatatgcttcaatttgtagaaaccacaagggttctttttaacatactgacttcgtacccttcagattagcatgctatccaagtatcctgtatagaaacccttcagcattcacagtgttatctcccctacttgagataaagagaaaataagaatgaaaatataaccacataggtaagggaaggaatagctaaaagatttaattctgccattatttttcttcctgtcaaacatagaatttgaaccgcagccagtttttatatgttaagtactgccattctgtcctttctccatggctgctgatgtatatttttaagacaaatttttaaaaatacagagaatgggattccaggatgggccacataatttgtgagacctagtacaaaatgaaaatgccaagccccttgttcaaaaacaattaagaattctaggatagcaacagcagagcataaaaccaagtgtaggcccatgtgcaactgcacaagtcaccctcccacaaagctggccctgaagggtttcctatttcaggggaatgatcttcctgttggcactttgcctagcagcttttcagagtaaataccttcattgtatctaagagcattgagacctgagcgtcagagagagtaaagagatgtgaactgtccatcatggccatgcagctagactaaccagtgtagttactgatcattgtaagatggtcagcaaggtaattcaattaagaataatgagataattcataccatgaataggatttcagtattttaagggttgagaaagcaacagaggaggaaaaagcatttattgggtgtcttttttggataggagccatattgaactctttttaatgcattatcatgtcttagcatgtcagccatataaagtaatctttattagctcatttcattttctatctgaggaaagtgaatctcaaggatataaaataacttgtttatagtcacacagcaatcattggcagtgtggtgattgcccacaactgtcttcagatcaagcccatgttctttctatgggtattggtaccatgaggctgtctctcttgaggggctgatagacacaataaaagtacagacttgagaagcagatgcaaacagcactagcacaattagcgaaatttagcatgacagtttctttagtgtaaagaatctgaacccagcacaaagtgaggccatggaccaaggacagaacatagtaaataaaaagagagttcttattatcttgaccagacaggagaaactgttgtgaggggaaaataaatctcgggatccccaaatcactaagccaagggaaaagtcaagctgggaacaatgtcagtcaaacctgcctcccattttatttctaaatacggtagctacaaagataagaagctacatacctccctcacaatttgcccacaaggaaataccttgtggacaaaggacagacagaactcaaagtcattcctctgaggctcacctgagacaaatgcatatctgattgcttcctctgccctctttgtttatataaaaatgcagattcactgagccagactaaattttgtattcagtggaaggctgatcaaagactcaaaagaatgcaaccttttgtctgttatctacttctaacctggaagcccccacttcgagttgtcctgccttacaggactgaagcagtgtacatcttacacatattgattgatgtctcatgtctctctaaaatgtataaaagcaagctgtactccaatcaccatgggtacatgtcatcaggacctactgaggctgtgtcacgggcgtgtccttaaccttggcaaaataaacttcctaaattgactgagatttgtctcagatattttgggttaacactgtctacctcacagtagactaataacagtggctacagaacaaatgtaacatgttggagatggatagatgataataccttgattgcaaaataatagttcctcctatagttaaagcaaaaaaaaaagtttcaaatgatgaaaatcaggcttcagtaaatacaatgagagtctgtgaagcatctgagggccagcatattttagggcagtatatttcaagcttcttcactcctattctactttcttcatgattttgccatgtgtaagccttaaaataccatgatagctgtaacacatattttacatttattgtttcatacagttagtacgaatggatttatcctgacaaaagcactagctttctgtccttagtaaagccactctactaattgtttaagctcatttgctcttcagttcattcaactaatatttattgaatgctttgtattttctaggatttgtctacctgatgtaggtggtaggtgggggtggagggaaaaagataagaagacagagatgagtagggcatggtacctgcctcagagggattcagaataaaatagtttcgcagtttcagattgttcatagaatgctgagaaagcaggattgagactttgcctggaggaggtgggaaactttatacaaagttgagcaggaaagtctagataaataagtaggaagagtttgttaagcttatttggaagattcatctttcctggatcttggccagattttttttaacttttctgaccatgaattaaaagacttcgagattttttatagtgttcagttcaatcttgtggttgtaatcaggaggttctcagattaagtttgtttaaccatcattttttgtaggtatggtaaatcaaataatagaaacagtataaccataactaatgaatattttggcatatagttcttacactcataatttagaatataggtgtgttgtgtgtaaatgtgtttccatttcacctgaatttctttgtacagattttacagaataaaatgccagttactttcttctactgtttatttttccttatgaaaacgttattacaaaaggtgatttatatgttacttacaacacgtatttaccacaactatttttgtttttgtgcttccagtgtaaaactctttctggagtctgtgaccacatcatatccctgtcgtcagatcctctggtttcacagtctgctcacctggaagtgattcaactggcaaacattaaaccaagcgaagggctggtaagagataccatgtttatcaaaaccaccatccatcagtagagagctaatgatgtggacaaagcagcctctgaatgtgggaatctatgaatttcaacagacactgaacattttggtatttttttcctggaggagttatggtagtggaagtttgtgatgcatgataagaagttttatgaagataaatgaaaatgaaggagaattgaaaatggtgacttctgaattaatttaatttggtactcatttagcttcaattacattctttcacctccctccctaccaaagttccttaggtttaaaggaagtttaagagttttataataaacaccacaatgttacctgctcatgaaagttggttttttgtttgtttgttttgtttgttttactttggtttgttctggttttaatagttattccttcccctagggtgggttagctaaacaaaactgatattctttataactcgcattcattcttagaagggtaagtaagcacgtggatattgccaacactagatgtctatgagttgtatttttttattatgtaataataaatataatcatgtttgatattttgttcacctgattaaaaagtgtattggttctagatttaacccaagagagagattttttaaaatataagtctataggaagaaagcatataaaaattgatattgagacagaaaacaagaaactggctagagaatatcttaactactacacaactattacatgttagtttggtgctatagtgtttccactttctccctgtatatgaatttaccaattaatgatattttggaaaatagaaatcttgacaactagcattaataattgaattcagataatatattctttaagatctctaagcaagtttaactttttctgtggcttttctttttcatacatctatataactgttcagaaggcaaagcctttattgactaccactgatttttcagtttgaggccatctatcctagagagtaagttttctgcagatatgtggcaaattaattctggttatctgtagttcctagtgctgttgtggcttttatgggtgttttcctgggaaggaatatgatgaaaatcagcatatcagacatagcatgccatcattgtgatctgtaagtgctatatctaatgttgattacatttagaacttctgttaagtaattataatctaaaatttttttattccttttagttacatctacaaagtccagttttatttttaaaacacttcaatctatagcaataaggattggcctttctatgtatccccttttagtagttataagggaaaggaagtcccctaagcatgatttttagagtgaaaaattatgaactaatacaacattgtattaaactagaagtcagaacacccagatacaaataacttacataaaatataactatgagagtgatcttgaagagatgggagagtaaatttaaccaccttggccttgatctagtcatgtaggtgagggagatgaggagatcatctttaaagctccttctggctcttagtctgtggttctaaaaagaaaaaagcctgactttttttctctaatttccactgaaatcattgggagaaataaccttgtaaaataagtcaaaacaatgctaattaatgggctttatgaaatcttgattttttaaggaaggtatagccctggacaggtcctttattgttttcatttgaaagaggtagatctgggaacttaaaatgctaagaaccagattcagttaaacagtttaggagagagctagaagagaaaagaaatgaatgcccatcacttgccaggtatttttctcacacctctatagagtagatattaattttctcattttgcaaatgagaaaataaaattgcacatattcaccagtttgctctgtatcacatatagacaataaataacagaggcagggtttaagtccaggtaaatctagatgaagtacatctgaacaaagctttttttactattccacattcaaattttgaattgctaaacaggtatgagaagcttaggaggatgactttaaaactgaaattacttagagaaatttgtttttaaaggacaaggggcagcacttcactgggaattgaaaggaaggaaaagaaaaactcaaaatgttgaatattaatagaaagagttaagtataaaactattttttgtgattcgtatcaaaggggaagtactaaacagagaatttacatggcttattcaaggtatcgttttaaaactcagtcacgtttaagtaagtttagtcagtcacatttgaaataaaccaattttaggattttgatttaggattttggtaattagccatagtaaatgtctaaatgataaatgaaggaaagaaatagaaagcggtgggagaataccaagatttaatgaaatttaattagcttagaaatatccacagaaggtgttcttccaatgttaggacagaacatgtctcataggcaaaaggtaactgatttgttctcctgctgataaactggatacatcgtttatcagctttctaattagtcaaatctcctagaatttcttaggtttaacagtcctaaagcattgtaaggactggtgagaaacaaccttagttatgattgaaccatatgaaactttcttctaaagtgcttttaaacaacaataattagcagaaaattaaaggaaggaaaatgagagctattgaaacaaccaaactggatcagagccaaggcatgagccaaatagagaggaagggactggggtcatccctggggaaacctcttggcctcagggagttctttttctatttgggtacttggaccatctccaaatatgccttattccaccaacttgactgagaggttgctttggctcctgttggttaaccaacatttggagacagagcaaagcaaatgtcattttggcaacctgagcaggagagagggagctgtgcaagtcagctctagaattaattaatgaatttttaagaagagagaaaaggaggaatgaaggttttgatgaaatggaaagccatatttgtcacggttccagaaaaagagtcatttgaattacatgtcctcctgctgtttggccctttctcagaggtgaacaatgaatcagatgtatttctctggaccctttcttattcagaagatgattagtttgaaactcatccaagcaacttatttcttctctttcttttggtgcctgacttttggccatttttctcattactactatgagagggagattaaaaaagacaaagaagtcagttttgattattaaaagcagttacaacatggtttattgagtttagaagtgaaaatattacataaaacaaaatatctttattcttgtggcatttaaaaatttgttttatttctaccctattgctttatgtctatatgtagatacatctctaagcatttaaaatttttattcatctgaaaaaaaatagctttaatataaattgtacaatgttgtcatgatgagatcctcttcctataactactagatactgtctttggcttacaattgtcagttaagttcctggtatttgtaataattatacacagataaatttagagtcatagctatgctgtttccatgattttttattatcccaataactacagtgtcttttctaaacatttttctttaaatattaggctttctttatgacctcatcatttatagaatcatttaggactcttgtcaaacacctttaattcgtagtcaatagtgaaagatacatggagaaaaatagaatcaacttctgcttacagttgtcaagatgttgacagctgttgtgaaacctcggttcttcttagtttaaaagaacttaaacaagagatacacagcaaaggagatgtagcatagagcaatttattgcaaaggaaaaagaatattgtgaaagttaggtgcagaatagccagtacaccctgagagaggattcagggcaggctgctcctgaggatgagaccgccaagactggcactagggagactccctttatgggagtcttacgtgattatttatatgggggtgggaagagctgttactagtaagcatgttctgggtggtcctctgggtgtgcacgtgcacagtagctgtacatgcctgttcatatgttgcatgtctctttagcatcttaaatctccacccagggctgtgctttttactattataatgagcaaaggcttagtttgaggacaggtaaaatcaaaatgcacgtgctccctccgggggaaatttcctagctgtgcttgaatgagcttgactacattgtgaatgctggggcttattgtgttaaccatacattcgccacagttgccaaattccaaggacatgttaattccttgactacctatcctgcctcaaagagagatgggtaattgaaatgaatttgtaaaatatcaatcccagttattcttttagctacatttcatatactacatatttgctaaagtggtcttagtcttttagaacagatattaaaaagtgaatgtttgactttaatatctacagtcatcaaatattctaataagaaaagttaaggtgtacaactctcctaactgtaaataaagccataaatcaggagcccagtggttgagagtgtggactctggagtcagactgcctgggcttgaaagctggcttcaccaccttgggcagactccccagcctctctgtgcctcagtttccttatctctaaaacagagataatgatagtttccactacatagactattgtgaaataagtgcaagacacttaaaacagtccctggcacattgtaacaagtagatattaatggtggtgatagataatgatggatgataattattttgtgtgtccgaacagtgtattttgttttgttcactttttccactttatcctctcacaacccttatatgtcaaaaactaaaaattggccaggcaccgtggcttatgtctataatcccagcagcgtgagaggccaaggcaggcagatcacctgaggtcaggagttctagaccagcctggccaacatggtaaaacccgtctttactaaaaatacaaaaattagctgggcgtggtggtgagcgcctgtaatcccagctactcgggaggctgaggcaggagaatcacttgaacccgggaggcagaggttgcagtgagccgagattctgccactgcactccagcctgggggacgaaagtgaagctccgtctcaaaaaaaaaaaaaaaaaaaaaaaaaaaaaaaaaaaaaaacacgaaaaatttactctctagctcttacaaatgtgcagtcatgcttcatttaatgacgggattccattccgagaaatgcatccttaggtaatttcatcattatgtgaacaccatagaatgtacttacacaaacctagatagtacagcctactacaaacctaggctagatgatagagcctattgctcctagtctacaaacctgtatagcatgttactgtactgaatactgtaggcaattgtgacacagtgttaagtatctgtgtatctaaacatatctaaacatggaaaaggtacaataaaaatatcattacataattatatgggaccaccatcgtatatatagttcactattaaccaggacgtcattatgcatcacatgactgtattttaagatcctttattaatctgatataatattgttaattcctgaatgaaaaatatttacagagatcttgtcctcttctaagttctaaaataataccattatatttaccgatcagtaaataatggggtaaatgttagcttcaaattaagtatgttgtatacctgtcaccagtgtaaggctgaatattaccatgttgtcataggcaaaaactactggccaatccattaattaaattctgattgtacttttgttaaggttatttgttttatataaagtgataagcattcattttgtttcatattagcaatccaggctcagccattttagacatatggtattactgaaatgactttttagaattaaaatctacccagtgatttctcaatagttccataccatgaaatttactacttatttttctaatctcttattttcagtgaagacacatgtattttcaggtatctaaatatataattaacaaaggtataggaaattaacattgtagcaattgcttcatgtaagtactaaatgtatgctttttctgaaatggtattgttggttgttattattaaatctatatttcagatttgaagttaattaatattaatatttttatttatgaagtaagtattttgaaatgcaaaccacttttataggtaaaatttgggtagtttttccccgaaaataaatttaaagtaacaatcttctttggaggggacaaaaattcattaactgaatcatctagtttgttctgatttacttaaattatttaatattaaaaatgtgaatcccttattgtgattttttttctttaaagttccatcactatccataatttaaagtttccacttgctcttaaagtttgtatgatttcaggatttctgtataatttttaaactttaatgtagttttttctaaaaatggttctatttaaatggaaagtggaatcttgtcctttttactgggggaagggattgctacagatacacactaccttttaattatcgatgtagatatgattggatataattagtaaaactttatcaataagaaaggtggaaaatacaggatactacaaaatagaaggagaaaatttatgtaaattatattttatcactcttctggttccagttataattgaagtgtctcattagaaaactactttccattgtataatatatcaagtataataagttaataacataccaatattttaatttcccattgtaacttttattttgccacagaatatgcagtatgggtttttggggagagtgagagagtttctttcttaggaatattgaattaccatgctgcattttatcagtctcacaggcaattcacttatcaagtagttatttaattgagtataggcttcttcagacaaactttagaaaccagaatgttcagatagtaatttctcaccagtttaaagatagcgtctgtcttcatggatttatttctggggcgtgtggcagttttaatttgatagagtaattttttatataaacgaggttacaatgtacttgaaaattcaccaattgcttcactttcttttctgatgctgtctttttcttagggtatgtatattaaatctacatatgatggcctccatgtaattactggaaccacagaaaatgtaagtattctaacctttcaaatttttaagtgtgtttttcccttttattgctaacaacttatatatctcacatgattgaggttaacatctaaggataaggacatgaacagatagtagatacaatttaaaagagatactgagttagtagcattcattctgttcaaatttccctttttttttgtttagaatagctgtttacttaaagtaaatcaggtgttttcagccagagatttgtctttgtattttctgattcatgacaagttattgtgacatctgaaagaattcatttccatctgtcaaatgatttggttatttaaagaaactaaactcatgcgagaaataaatatcagataagtcaggttttctgaatacttccagtataattcagcttaattcagtggaagggcagcatggtatagctgagtggttttcacagtgacattcctggacaccagcattagcctccctttggaacttgctatatatgcaaactgttaggccctaccccagacctactaaatcagaaattctggagaccagcctatttcttaataagagattctattttaacaagtgaatctgaggcatatttgcgaaccaccataagcagtgggccagaagtccacaggcctatgtctttacaaccagttctgcatcttaatggcagtgtaattttgggcaagacatttaacctctcattgcttcagtttcttcgactataattggaaacaaattatctgcactacatacctcactaggttgtaatgaaaattaaataagctaagaaaaggccatgctatagagaactatctgtgttatagagagaaaagcatgaagtgatcatgctggatattattaacatgatcagtgtgatagaggtgaacagcataatacatcatcattcttgcatttggttatttcagatttccattctattattatataagcaggtactgagctttgaatgtattttttttttattttagagattctgccaattgcatgcatatgcagtgctcttttaaagaagactgaggtggaattagttcaatctcaaattattattgatctgaacattttaccagcattttctttttaaaaatcaacattcttttcatctaattcccctatgtaatcacttactgatatttttccttgcttctcttggtttcttgtgaaaggtgaaacatatatatttgcagttggagtgcaggagcagcttcacatttggtattaaatatgagagtcgtagggatcaagaatatcagtaacatgcatattatgaagattttaacaattttaaatgcagttaagatgctacaaactatatgcttgtcatcaattgttcattctgatttatttattcattcatgtattcatttgttcatttaacagacctctgcttcatgtctgctatgtttcaggcatggtgctaggtattggaagaattttaaaataactagtttggtgccatcaaggcgtggagagcatgtgggggttcatctttataaacagtagtgtaatttgcatggatggacaaagggaagaatagtaaatactgccaagtgaaatcagagaaagaatcacagaaatggttattttgaactgtatcttgaagaattggtaggaatggatctctatattgtctcaggtctgcaaaaaaatgtggagcactgtcttgctcatattactcactaatgtttcataaatagataagtgatcaaaagagagattgagtctgggagtagttcagatatgaaccatatattaatagttcatcttttgattcttttttttcttaaaaatatttaagtatttttggtaacctcagtcatttataattaggagatctgtcttgagtcttagtaaagctgctcactagagtgggtaagttattttgctttgctgtgccctaatttcttagttttcttatatgtgaaatgaggcatttggacaaaattctatctctaggatctcttttaaaactaaaaatctataatttatatgacttctttacttacctgtgcaaaatgtttcagtttctttgaattttatatactatcattttcttctacataatgactagagccatttgctcgatattttttccatactttcctttaaaaggatcagttgtgaaccaaataccacaggaaccaactatagttacaaatatattaatgatttacaatcttttcagaattgtttcatggtacttgtctgacttggtaatatgtccccctcctaaaggtgctgtgagattaaaatattatattattgttatgactctattcttagagttttttattgtagattgatctatccccttaataatgtaattgtgttattacttcagtaactagaactccctggtatgttgtcttatcttgaattatagcctatgacaaataattttattgtgaattttaaaaatgtgttgaatggaggttaacattgtttcaagacttctatgttttaaaaataattggaaatgaataaaaaacaaactggaaatcacttttaaagtatgtcctactccagggtctcaaaagtagcattgtactttgcagattacattaccatattcttcttctttagctttcagtagataataacgaagagtatcacagcatttatgtttgtgtgtgatagataaacacatacacatctatctagacaaatacatttttataaaaatggattttctatatattcaaaagcatattaaaatgcatataatcaataagtagctaacaagaaaaatataatattttaaattcattactcagacctgcaatataaaatttctatcttaaatctcattttaatttcctaaaaactccttaaaacttgtcagtattagcttaccaagtttgtttgtttttgtttttcatcccttttgggaataaaggaaaaaagtgttagattattgcattctatagaaatattggcattttagttcattgaatgtggttttactgtccagtgtattacactatatgtaacatgagaaatagcatcctcttataactagacacttagcatgttatgtaatatgatttgaactaattgctgtccatcttttaatttgctttgctagattattcagaattggtgttactgatgaaataaattagcaatttaattatcaaacttcaaatctttgatgctgatcatattcatgtacttgaaatggatttgttgaagttaatgtgaattatttatatcaaatggaaaggatcacaatacaaaaagatataattttttgaaatgcatttttgaagcacttacccactagagcctaggagagttgcttgtataaagtttacaaaggttaataccaattatcattttttcataatgctctcagaaacgtgttcttttataataaatatctatatattattttgcatttctgtttgttgtcattagctatgcatagaatgcaaactattttttattaatttttttctttctatgtttatttaactggctcagcaggtaaaaacagtgtattaaatactaataaccgtgtttattgctttaattccttgaaatttttaattaatttttaaatctaatttatggagatgaactttttgtagtgtttccagagacaggaaatgactgataaaatttatgttctttatcgtttcttttatattaaattcagtcacctgcagatcggtgcaagaaaatccatgctggcgatgaagtgattcaagttaatcatcagactgtggtatgtataattaacttaagagtcagtgggaggaactaattttgatttgctaaagctttaaaagaatgccaatgaaatgaaattcctgtttgtatacaaaatattgaacagccttttgaaaaaataactgaatatttattcttcttaattatttgatggaacgtaaagcatttttttaaaagaacctgaagagcattggtggtggttgaggttagatatacatttctgtatggaaaagtactagataatagtatatattccatgaactggaataacaattttggaatagaaattaaagtgacagtatgtataaattcaaccttttcttgatacaactttttgaaagtttcattttataaattattgaattacctagtagatgttttataacagcatacatccatttatctaacattgatttgttcattaaagtatctggtggttttggggggagtattttaaatgtagatctttgaaaattttaaaatttttaatagctgaattagctttttatttcctaaaagaggacaacagttttcattttaaaaaatgttcttgccctatgaacctcacaaatccctttgttatctacccttaaaaatctacagtaggcacagaatcccactgccattttttataatagtgggattctgtgcctattgtagatttttaagggttatttttcttaaacttaggtttagaaaatgaacattatatgcttttcattttggactattttatatgtctcagttgattcacttttttccactctctctgccaaaataaagtatatttgttatcttaaaaagttaaaataatccaaaattattaatatcataactcatttgaaaaaaggcagagtttttattagtattctgctcctcgcttactaactcatcagagtgagtaattatttcctattacacaatttaactaaatttgcttttgcatgtcctagtgatggaagaaattttgtgaaaaacctgatttttctcagtgattctaatcataaggcaaatgacatttcaattttggttttgaataatttgagaagtctgtgatattttggaaaggctcctagacactgataattaaagccatgatgtctcttcaataagttcattatctaagtgaagtaaaagttggtaaacgttttcaaaattaaatgcgtgggtgtacctttgacactgaataatagagtgttggtagtagacaaagcctttccacactatgacagttttgatggctttcttttctgattactagaaactgtacaaagtagttgttctgactgaagtttcctgtcccataggatgaggatttgggcagtgggataaagcagctgcttcagtagacgagtagcttttccctcttctaatgtttatgctgcttccatttctgcaatgtgaccttaacaaacatgacatctgttgaatagtttcagcatgcatttccagatggtcattaagaggatagagattagtctctaataaaaataaaattatttaaaggatattgtttgtggaacaaagatactggtgtttatgaaatgaatatgaaagcctttgaaagtctacaaataaactaataaaatctatgtggattggtgacatttaaatacacctagaatgtgtaaatgcatctttacatcacaggaatattctaaaatattgaaaactacacagaatgatctttgggaaaacttggttccagctcttgctctgaaattgacttatggctttaagtgagtcatggtaactgtgcatctgtttacctttttctaatgataataaccatagctaacacttattgtgttcttacagtgtgccaagcatcatgttaagtattttacatattttatttcatttagtccatgcaataatcctgcaaataaggtatatgtagaaattgagactcagaataattattcagctcacccaaaactcaaagttctttgactctaagacccatgttcttacttcaattttattatactccctcccaaaactcaaaaattatataactatccaacaaaagaggaagaatcctaacaagcatgtaagtaaatctcaggattcaatgaaagattaagtggggccaaggtaggagaagaagaaaggaagtgagaatttacatagctgggatagcgagccagctgaactgaaattagaaatagggttgaaacttaactttactgccacttcctcactctgcttctttcactcagataagtaagatatgtaaaaacacctgtcataatgccgggcacacattaggagctcaataacaactttgcaaccgcctttcttctcttttacctgctacaacagttggaccaattggaatcctccttcttggcatactgctactagagccaacaaattgattttggaatataatagagacaagatagtatgttgaatttcatgaaagtagacttttttaataatatgatcggttgccaggtttttttgtgttcaagtagaggcatatttgggcaaaaccaatgcatttcactaaatgtagcctactctgccctctttttcttgctgttgcctgtattgtggtctgtacagtgcatttaatctcttattagataatatacagaggtggtgaaatggaaattctcttaattgaagcaagtataaattatttatagtctgcaattatcccttctctccctacgttcattaccatagggtttggttatgatataatagttacattaaagtatggcctaataaatttgaaatacataactaatattaattctctaatccattaattgactagaatagtgagattgccagtattgttccataccaatttagactcattaatgaaaagaacaatgttaaatcttataattttggatgatactaacccagttagtatttttctgtaattctaaaatttcctatgactataggtagtaatgtaaaatataaaatctgatatttttctttacttaagataaatacaaaaattattttaaatatttccctaagagtctaagaaagttgaataaatcagatgaattcaaatactatttttttaaattgctagtatggtatatcttcaagatgtctaattagatgcctatgtttctagtttgctccttttttaaaagtattttcttaattgaaatgaaactggaagttttatgtcctttttcatgttgctatattctctgttataagtggcttttaagtttttcaaaccaacatacttctgtggctgagaaactgtggctgccagataggaagaagaaaaaatcatgaacatccaagcaaagcagactgagtcttattacatgtcttccccaccattgaagatccaactcctcaaaggctgctggaatctcccaagattttttccacttcatctgccactacatccctctctctgggagatacctcggcatagtttgatgcagcaactctgccctcatgatgcacttttaacacatttttttagctgatgagactacttatagttattaaaattattggggcatatttataatctgttcaatttcatgttaatactgtttttggtgtgcaaagggttctaaagattctatccatactaaaaacagtctcgggaatatcacttgagaagagtggcatatatgatggttgaatctattaacaacatttggaagtttttccttttattttgtattaatattaaaacatattcactgttattttgaaagatattctggaacctgatgactacattatggaaagaaatgtttcaatagatgaggctataaaggatactggaatggaaaataaccaggttgggatagtcaagaagaagatagactgcagcaaataggatgttctacattgattagtgagagatggaagataagtactataagctagtggtttttgttacctccaaaatgataaacattgttgagcaagactaaggatggcagagagtgtgggaggagggaacagattgaaggactatctcaaaacttcctctaacttcatttatgcgtctcccttactctcactgttgtctctcattttggactctgtcctcactctcttgttccttcaaccccagaacaacaggagaatattgttcaaaggagaagccaacataatcagaatggatagagagtgtggtatccccttaatattcatctctccttttccctccctctcaatttacctccttccctggacttcagcagaaatgaatgagtcattgagtggaatcaataccatgatattgtctaacagcagatgtactttctttctcttttttgatttgctaaattgttgtctttatttttttggtttttttctaattccattttcttttctttatcattctcatctcttctcactggactatttctcctccactcttcatctcattaagttttctttgttcttccctattttcttctgttctgctttctcagaggagaaagtatttatcatataattccatatacctaagatactgaaaactgagaccacaagaggcagtgtttctggtgtaccccacatcttattcctgtaaacacacatgttgctggactacagagattaattatgttagcatggtgtttaacatattgcttaataaataatgggttcttataatagcctaaaataactatgttaggattctgtgaaatcagtattctaaaatagaacaagtgaatcattctcttttgggagggggaaaaattatgaagagacatataccaaaaattaaggaaatgatgcatcaatgattttagttactcataataatattttatttcagattctaccttatgtagtggtttatgagagcttcatagattgtttttcttttatttcacattgaacattatggatttgatgagaatgtgtggaaactggttttgaagtgatacgtattgatataaactgtatttttattttgtacagagaaatcaatttattactttatcatccaatataatatttcatgtttctgttatcaaactaaaatttattatcttaagtccttatataaaggagataaattgtatgatatctcaataatagttacttcctgttaaccaatttattttctctgcagatctctgcatcctgatttgtttctttcttatttgtgcagttcttactagctttaccaggaagagtagttgcttttttaaaatggttactgtttcattttttatgattaaactttatctttcagtgtcaacgtggttactatgatctagttattttacatggaatttttagtttccttataagtttatttcatgtgtttaaaatgtatctattggctgaagttcttacctactctggcttattaacttattaagtgtatggctcatttgcaaatcagcatcatcctcagtcaccccccacccgttttttttttttatctctttcataaaaggaagagtctgccagtcacaattgcccaatccacttccttttcatattaggagtaggcaatcagtagataacatttaactgcctgataaaaaattatcacatgaaagggaaacgctaaagaaccaccatataataggaaattaaatagatgatggcattaatcttaagttctttttagtttatttagccctaggactcaaggataggtttcatccactaaattaatattctgattggcatggtagctcaaattgtaggtaacatagccactcattacttttacatttcctctcacactgtcccttctgcatcttattatcctaatagtggacaataaaggatttttaaaagttggaaaaatggtatatagaattcactatggtctcatatggagctgacattgagttcctttttttgtctgagttgctggaattttggtaaagtgatttctaaaggtaacttccacagtgaaaatacagccattacagaagtttttcttactaaaaattctattaataaagatttaggatgatacttttagctatatatatatacgtgtgtgctttagttttgtgttgtgataaatatatacatatattgcagtatttgctaaattttcaaataagcatatttttgttacatgtctgctagtaaatgacattgtaaaaatcatttatagcaaagttgtacatttttaaacatattactttttgaatactagggtttgagttgctttttaattttgtcatttaagttcctgaattaaatttaagcatgaattttttgtaagtatagattttccacaaaattattataaatgggagctttaacattttagataaggatgcttcattttactccttagctttggtgactgggagtcttttctttttatttcaaaatacatatttttccagcatctttgtaagaagaacagaaatgaaatataggaaggaatggctgaaatttaataacttaataacccatgtaaatatcttcataaaaaaattagttaaaggcctgtattgtggctgagggcggtggctcatgcctgtaattccagcactttggtaggccagggtggagggggattgcttgaggctagaagttcaagaccagcctgggcaacatagcgagaccacgtctctacagaaaatttttaaaaattagccaagtgtcgcagcatgtgtttgtagttcaaactactcaggaggctgaggcaggaagatcacttgagcctagaaattcaaggttgcagagggctatgatcgtgccactgcactccagcctgggcaacagagtgagactctgtctcaaaaaaagaaaaacctgtattattatggttattttaaaatatgttactgctcttttggggactgaggttctacagtatgatcagaggtttacattacagctttacctttcactacaatgtaattgtcttcctccttttctctctttagcaaaagctttcagacccattcagttttatgttttgatgaagtaaaaggacattgtgaatgatgctgaaataaaaacaaaattggcttttagttttctgtagcatatatgaatgaaaaccatgaaacctccgaaataaaccttaagccttgaaagaccacagcattaccaaatgccatattggaaggggagaaggaaaagtgagctgtatgttcaagatgctgaactatacccacagctttggaatcagcttatcacaaaagtcaagacaccaactatacaaagtccgcagttaatataagtgataggttacaggagatagtgcaagtaacagggtatggaaagtcaccacctttggtaaaactatgtgggtgattcataaaacttacatgaaaaattattatcactattttctttctcccatgaacttcgttatgagtcaatcaagaaattctgatttagctctcagaacttcttgaatgtggggcaaaaagattccaggggagaaaaagtgctagcttcttgtagtgtttgagttgcctctctctcttggactctctgtccatctttagctgtgagaaattatgttctctgttagtgctttctttttaaatactacatatttatacacacacattatatatgcacacatattcataactgtgaaattcacattaagatattaagtattaaaaaagatatatgtaaattcagattgttagcagctcaacatggtctaagttttactttgaaattaagccacgttaaaaaaccaaatgccttgatgtactcttatttcactggataagtgccatttaaagttcaggaggatgtgagatgaagaatggctcaatgaataaagacattaaattgtcggctttttttctctaatgaaaataaaatctttcccgtatttcttcttttcaaatgtttgttccttttatcttttcccaagactttcttcgaatcatgtttataaaaatatcaacactaaagttttatttaaaataggtaaaccttgggacatttctgaatactctgaattacctatttaagttactctaagctagggttaaaaatcacttatttgcatagttccttaaccactgcatacacattagcttatattcctttgtacctgaaccatgactaattctttatttctgttcagtgaataaatgactgtgaaagaacaaaattaagatatctccaaatgtagtagactttaatattgtaagactttttttattaatatttcatgggaaaaaattaggtgaagatggatttcgtagattggtactcattatttaatagttttagaatctttgaaaggcactgtatatcaaaattcattatttctgaaatgtttataacagtatgctatttccttcacatagattgttttcccaaagaaagaggtagtcattggtataaaatgtttaatttattagatacttcagtatctttttagtaacacaaagaaacagaacattataataaatatgtcagcaccaaaaaatttggcaaagactgagtgtcattagtggcagtatgatggcttgtgtgttgaattaagtctcttcagtgctcttaaaaagagcaggaggatatttgggtgtagcatgactcatattaccagacattcatataggcatacttctagtctataaaatttcctttgggaaaaggtatcatctacattacatcctgtgagtaagagtgtgtgtatacacaggagtgtgtgtaaatgttgataatgaatctgtttctttgtcttgtgtagggtaataactttgaaaatattttaagaaatgttctatcttcctgcctgtgggtgtaaagatgctctcttgcaactccaaatatagccatgaaaaaaggtaaaaaaaaaggtctgggttgataggcttaaattcttacctttatgtttatttgtaactggctacttgggaccatagagtagaaattatcttttcatatgttagtcaaataactcaccagctgttatttggaaagcagaccagggcaagttctaaaggggtcagagacaacttcttccctctatgtactgaggggaaaagaagcctatcatctcttcagcaccaaccccaaagcctcttgtgcacctaatccaggcaaccaattttccaggacctgcccacttatgttgtccttcacaaaggaacacctgctgtctgcttcagcctgatcaaaacaattacaagccccatccacaagaaagcagaacctctggcttttagcacttgggattccttaatgaccttcttgggaaattttaatcctgtttatgttgtgtgtaaaatacattttaatgtacatgttggggattatatataaattagtaagctatatgacttgctgttgcttgtaggcactgacttctgctaccttggataatgaagaagataatagtagttcagtgtatgtgaaaaacattatagctaataataagacatttgtgtaaaaatgcatatggtggttttataaaggttcattttagcccatgaaattaatgtgaatgaattactctattaaaatattgataaagcactacaaaatatttttctggaaaaaacaccttcataacagtgtttatatgatgcatatgataaagtaaaatttttccaggacaaataggatctatacccactgttcttttccttgttttaatcacatcattatgactttaggtctggagtattcaagatagaaatgttttttcaaaggttcatttataaggagaaagtttatttgaaattttgaggtacagaatgtctattacagctttagtatcaagtattttacttttttggatgagaggtcatttaatcttttatgcgacaaattttaagtatattacatataaaaaatattttaatactatatcttggttttatgtacaaaactaaaccctcctttcgagtttcaaggccctttattgtctctgaaacatttacatcatcatgtcaccatatcagctcactagtcaagttatgcagtatgccgtgagattcacatgaggaaaatatggtgtcacctttaagaagaggctttatgatgggtactgcatgtaagatgaacctttatggataggtaagattttataagtgagagaaaaattacaagcagagggaagagtggttttgcaaagatacagctaaagagaaaagcacagtgtttgaaggaaacgtatattcattactcaaccaactcttttaattatcaactttctaaaagcctcttataatcatctgaactctgtgtgtttctcctgcctcattactccttcccttgttctgtcatctacgtgtactgaactactgaaagttgctcaaacctgtgatactttgcctcagagctttgtttaccccctcaacctccacatcttcttcacctgtccaactcccaaggaatttggcttaaactcattggaaaccttcattagaccctcaaggatgggttaggtgcccctgttgggggctcctgttgcactctgtattcaccctattgaggtacttatcttactgcattgtaactgtttattgctccttaatgaggtacagactgtgctgcattcactgttgtattcatactacatggaagacacacaataaatacttaagagttgtcttaaaaacatatgaaacacctaaactaatctagacatgagcaagtcactgccttcaaggagctcataatctattacagaggttctcaaattgtggctctttaggccagtaatatcagcctcacttggaaacttgtattaggaaataaagggtcgggggaggaattctcaggccccactccagaactactggatcaaaaactctgggggttaaaactcagcattcttttaacaaggcttcaaggtgattctaacacatgctaaagtttgagaaccacattgaagaaaagtaatctgagaaaaagctgtgatcaactataccgacaaaggacctgtttgaggattggttatttgttccttagttgggcctttggagagctattaaaggttttgaagcatagaaaacttctacactgtagcagtattttggagctgcaaaagactagaagcagaaagacaggttaggattctggtttaagtctagcagtaggtatccaagccagaactaaggcagtgagaagaggcattagttgctaggatctatttgttaggacacaaaatagattaaaaagaggagaaaagtcataggtgactccaaactcccgactttagaggatgatagggaggtttttttgttttgttttgttttgttttctggtgaatgaaagtaaagagataatgagtttgatttttaaagtcttgtattcatgtaagctaccagtggatattcaagggaagatactgtgctttagaattgaaaagacattaatgtaagttctggcttcaccacttactatttttgtaatcttggccgagaaaacaatctctttttgcttcagtttctacacacgtaaattgggtttaatagtttacctcattaggcttttgtaagaatgaaaatataaataaaaagaatgtaacatagatatgaagaatctagcacagtgaattgttgatgcttgcgattattcggtagctattaacgtggacaagctaaacagttggaaatatgactagagttattgataggaagcaggaatggtagaaagatttgggaatcatgcaggaagctgttggtgaaagctcttaaaagagattattgtaagaagacagcatgaaatattagaaagatgtgtaacacttagcctagaggaaacaggtacacttattggtagggaagaggaagaaaagatggaggacaggtaggcagagatgtaacggaaccatgttattttactcaaactaatctttgtcatctattttcatgtttctacccactctatgttttagagttggaatgtattgtgactgaaagttacctaattatttgacctatgcaagaatattgaaacatctcttggtattgatctatttcacaagtcagccaatttcttttttggatatctttttctattagaatatttttcatctctggacgtggtggttcatgcctgtaatcccagaactttgggaggccaagatggggaaattgcttgaacccaggagttagagcccagccctggcaacatagtgagacttataaaatcttgacttattgagtacacctgaataataaatttatattctctcttgtcaatcatcaaggtataatgcatagagcagattttgtttctccatcaccaccttttagtgttttaaatagtagtgttgcctttctggttctgcagttttggtggaaattttccatccataacaaacagtcctgattaggtaattcataaaatttattattttctaattggaatattgctattcatacactaggttcatgtattttgttggtttatttgtttgtttagaagagtaactcatgcttattgccaaaagtttaggaaataaaagtataaagaagaaagtatgtattgcaagtccttactccctttaatctaaccaccattaatggtgttttctatatttatgtacattctttaacaaaagtggaataaaattatgtttgctattttggaacttacttttttcacacaatttttatatcccttactaatggatacatttacataatgtacaggttttggttgatttaaacaatactgtgacacatatgttgcacatttatttttgtgcttttatccaatcatttccttatggtagtggaagtagaatttgggagccaaagatatatactatacagttttgatgtatatttctttgctcttgtttaaaacattgttaatgtcatgtgaataataaaaggctgatttaaaaatagtaaaattagatacccaaattttctgccattaaataacatcagctgtaaaattaaaatccacccaaatgaactttcttgtcagaaaccaattctactttctgatagaaaagcaattctgttttttggaattgttacttaaaaagagcatgtagaaagtgtgaaagaataggatgaatcaaattgcactgaaaatttcacaggaaaataccatctagccttaaaaatcttcaaattttataataagtaaaatgaaaagaaattggtgagtagaaatcaatgtataaatcattgagaatagttatgctggaaaaaagattgtggccatcacattgaccactttagttagcaattatttgagtgaataattaagttacaaaatgtggttatcattaataagttgttcctaaactctttgtataagtagtatgttttctccctccaaacttgtaattcaaagtgtgcattcatatttttttggcaagcaaaatgaacccttggatttgaactccctttgctttaactcttggctgtagggatactacacagctatcagaggaatcggaatcaatgtaatatacctttgggcacataatagtccccacttacatataaggggaggcatttgaccagttccattactgtagttgatccacattaatgtgatttaaaaaaaaaaactggcagtctcattcaggttatccaagtataatgatcattttgattcatatctgagactccctgagattttaagtattataacatctcacttcttgtttgttctaacttcaccaacactcaattcagctatagttgaggttgcaatttagatgaatgcttattaaatataccaaagtccccattctataatagctgaattccagattacctcttcttcatagcctaggggtctgtgctgcttttggtggaagtgctcattctctccagcttgacaaatatcttccaggcaaaaacatggttattattagacaaagggcaccaattatctttaacttggatgcctagaaagaaactgttatcactgttgagaccatttgctaaatcctgcttacaatccaggataaattttgacctagtgtatttatgtaacacatcctggaaaagtataatccattagggtttgggataaaaggttcttctctcttctaaatgtgaattttttttaaaaaaaacttggaataatagacattttaatgtgtttctttaaagcatagtttctaggatttcagttacctgatactgcatcactagtccgttttgaaagcaaagtaacaaaaattattctatgttcagaatttttaaaggatgaagagtgaagtaattttaacaggggatgcagttgagcccgatttcaagacatttatcaagtactttgatttaattacacaatatgtttttaggtgatattcaaatagaatggcttcattaaatttagcacgttatattttaagtttatagggttgtttggaacacattccaatagctgcttcattggagtagtattatcttgttatttttgttctatctttatagcatggtaaaaggtttattgtattgctgctattgtccatgcgtaagaatgttgccttggtgtgtcagtaccagctattggtagtaaaatatcagtctaatttagagacactggtaccacttatctctaaaagatggtgatgagaaagcatgtggtgtagtttgtaagctcaggacattgccaaatccttgttttcaggcatatagattttttaactgtacttgtgaacagagcttggatctagacctagcagctgagcagcattaatggtgacataatttcattacattctgaattactccattggtaggataccattttagtctttgatttgacatggtaaatgtccattatgttgtctggtaatgatatggactaatgcaataatatggttaatcaattcaaagataaaatttattgagtatgtatctcctgaaaattgataggatggtacaccaattatgtgacttttttttttactaatcttattaaagggggagaacattaaatctttgaatactgtacctcaattttattgtaatgattttgctggttaccaggtggggtggcagttgaaaaatttggtgaatgcactacgagaggacccgagtggtgttatcttaactttgaaaaagcgacctcagagcatgcttacctcagcaccagctttactgaaaaatatgagatggaagccccttgctctgcaggtaatgaagcttaatcataagtcatacaccatcattttagccatagattatctcagtaatgcttctttattgtgcctcatctcagcagcatatggattaatcttgtatgcttttgaaaagttgtttgtgaaatgatctcttcacagctattctaataggcttaattgtgatgaaatccttgagtatctaaaacccaaatgaaaaacaactctgccttaatttgtaaacatttaaagcataattccaaaatgtcacaatttatttcatgccaaaatatggatagaatgaaaataagatggttcgtttttatgatatgatcttctattttatgttatacccacatactcttttagaagaagctaaatgatagtttatagaattcttttaaatcagttcataaaatagtaatagtaatttataaacagtaggaaaatgaaatgttatattagtaattaaaatgcacctagtccaaactaggcgcagtggctcacacctgtaatcccagcactttaggaggctgaggtgggtggatcacttcaggccaggagttcaagaccaccctgggcaacatagcaaaaccccatctgtacaaaaaattaaaaacttagccgggcatggtggtatgcgcctgtagtcccagctatgtgggaggctgaggcaggaggatcatgtaagcccaggagtatgaggctgtagtgagctctgatcatgctactgcactccagcttgggcaacagagactccatctcttaaaaaaaaatgtaccttgtacattcctcctgattgatcatttttctctttccaccctgtaaggtggcaaaaatagggaaattgttgcactagaatttttgcatttttcttcagcatgaaacatcactcttcagcatgaaacgttactcttaacattgataatatatttattgagttatcttgaaagttataaaaatatgattctgattgatgaaaggcaaggatgtaatgattttttttctatttcagtcaggatataatctttaaacttaagtaatttttgtccttcacgaaacgtacattttaaaaataagagactattaccttttcttagaagttaattaaaaaaaaataggcccattgaactggaacatggcccattattcatattaaaaaggaaagcagtatatgaaatgcattgttgtcactgctatgtaaattgttattaagctctatgttagtaccttttattattcatagattttttttcctaagaatcaaaattctccattatacatgaatggctttatagattataatgatttttcattgtttaaaactttactacttattggccgttggcattatacttaatataaaaacacatatatgtgtcaacattatggcctttaaaattttaatgtgaatctatttttcaagttaatatatgtaaaactgtattaatatgtccaaatccatttgacttgcatatatgtttattttaaaagatacttgatgatcattacagttcagaggtcaatgtttgcctcattatctaagtcatagatgagtagatcagactttcccattacattattttttttcactgcattataatttgctttgctccccctagagtttcctattgccatgtcttccctaaagatccttcttcaaagtgtaagggtgtgggaaccctgaaaaagaggcctgtattttcagccagtaggttttcttctctgtatatgtgagtgaaatttaatacctcttctttagtccctcatatttcacattaagcaccaaaaataccctagtttcttgttgatccatgcactcggtttgagggaatatctctagcacatgcttttataatctattcccctgttatattcttttccacatgcacaaactgaagtggagagttaaggtaatggcagtacccagttaagaatcattttcatataaaatgctaaaataattgaaagaccaacttttttgttacatatacattgggtgtaggtattcaaacctagagaaaaaggactttaattttaaaaattacgtcatgtcattccttaccctgtaagtgccttactcttcaggcactatttctagatccattccaaattctgagaaatgtgcctcatcagatcactaattatttttatttgtcatcgcttattcagctatgctgcatgtatttgtaaatttactttttcaaaatgctgaaatctgaaaaagaggaaatcagcattatataagtgctgtatatattgacatttttctaaatttgtcatttcagctgaatttggttcaactaaaagctattggccaaagtcaaccatccgtagataaataatactattggttgggggaggggagactgcttctaacatttttgaaaattacttcagttgttgcctttttacagagcagaggaaagagtattggtgttaattaaatattttctagtggctaaaacaaggtcttaggagtgaggacaatgggtaagtcctctaacataccgcaccactaccgaatctccctgatgaagaagacctgaaattgaaccattacagaattcttcattgatcttaaagttctggcttatgctaaaatgcaaagacacctgaaagcataatgaaaactagtcaaaatttttatagattatagattttggtacagaagatggacaaaatctcaaggtaccaggatctggagggtgaaggtacactgcctccagagcaggaaaagttaaagaaatagtgagatgaaaagatcttgaaggcagtttttcataacatcatgactttatctgaggtcaccttttcttcatagtacctaaggagctacctcagatgtgaaacgtaactgctaaatgtagtaacaatcctctacatagacaggagtgccatttttattgtattcttccttctggtaggtgcagaaatacactggagccaaaatgcccatcagctcatccaaatacaaatcttcagcattcaaacttgaaaaaatggaaatgaggttatttcttttttcatagggtgtaccagtagtctaccaagaattatttagaatagaggatacaaaaggaaataatctgtggcgtttatttaactcaatatgtctatttaacctttttgaaaatactatcccaggcttaatttacctgatagcatttatagattaaaatataggaaagtttgtagtagtatggaggtaggcactgatacatgtatctttttaataaacaagtttatcctaacataaggaataatgattttttaaacttataaggaatcgtttttatctatacaaataaaacaaccttatctatcctaagatagaagattgtcaaagaataccacgttttaattaaagtagtagttttatttctaaaaatactaaaagcatagtgacttccaatattgattaactacaatgatgaattttgatttggattttcttttgaaattcattgatgaaattatagccaaataaacagaagcatacaattcaacttcatgctcacagagcaatttcattagtacatttcattaaattggcagctcttttgatgaattcctgatttctcaaatattttgtgatagaacgtaaggacttaaccatcccttagtcaaatactacaagcaaatttaataatatctggaagctttaattctgttgtcattttcacccatttgtaaaaacagagatgtctcatctgagatagaatctcttattctaagaaaaaccagggattccttgctttctgagagctgcttttcaaaacatcttttcagtggcactctactaatttcctgcattttggtaggcatggtgattgcttatcatcaatttcttctaattcaatgaaaaaaaaacaaagaattgtggataaacctcaaggtatatttttagatgtttgtggttttaaattaatatgtgtaggccaagagcatagatgggtggtgtccttttcttcttatgagagatgtatggaagaattatctggacactgccaagaatgttccttggaatcatcactgggaatcaatgacttttaaaacatttaaaaacccagctttttttttttttggtgagaatgcatctcagaaatgatcactaaaatcagtgctggaattctcaacataatgacatatattgttcaagacatttttatataaaataacatcaagctgtaacattataattatgttcctaaattgtattctcatttataaatctctcattttgctgccatagttacttgtatgattttgtgattttgtgtttttccatttaaattttattgtttaacattaccttgatgccatttttagagcatatttaaatacatttgagcagaaaatagaaagaaaagagtcatagtagttgattttgtttatcaactggtgtaacaactggagaatgttgattgcatttgatttcatatacatagagatatgaatggttaaagtcattctggaaaaatcaaaatacataagtaacaataaaatttaatattcaagttgcaggtcgttgtgactgaaaaaaaaacattagtgacaaaaaaatttatctgtttctgagagttttgttttaaggagagcaagaactagtattaggcatggcactagagaagaaaatcaatttttaactaaaaatgtaattgggctgactgggagccagaagcaattgtatgttttacatactcaaatgagtaaatacatgcaagtaattgtcaaattttagctcaccagtctttaagcaaatcagtcaaaggatctaagtcacatttgtatttttgagccacatgctttcaagattttaatagtggctacagataatcacctataatgtaaaaattgtccattctttctttagttaacatccccaaaatgatgtttactgtaatttgagaaaatggaagtccagttttaatgttgcagtttaattatgcccataagactggacaatgcaggattaaagacactagtgttagcctcaatacaatgtgcagtatttcatgatttgatggaaaaagccattttatagtgtgactcttaagtctttattagttatatgctttataagtaatacatgttttaggcatatatatctgtatttttaagcctaggtagatatggttttctgatcaaatctgtggtcagaaaaaaacacttgttttctctgtattctgacaggaaaggaaaaattatatgcttataaaaggatactcaaaccttttgtatttataaatttgcattctagaaaaagctgtgaaagaactgagagtgggagaattttgaatatatgtatttcccttgcttcagttcttttcaaataattgactacttatgaaaagcttggccagaaaaaagtattcccaataattttccaaattagatctaaccttctttacatggtcaagaaactaaaaattatatgtgaattcttgctgcttaaaattcaggatacattttctctgaagcatttgcttagattattaagagagtcaatataaaacaatgttcttgtactagtgttgggaattaaaaatgtgtttgaactgagtaaggacttatgtgaatgttctgtgctagaatgatggggtattgtgatccatttgagtctgtgtttatccccaagagtgaataaaataaatggccaggttttatacttgatgtaattatttgtatttcagtgggtatttcccccctggaaggcaaagcaagttctgtgtgatcttggcattagtgaattttagagctaactacataaatgtgtaatgcactgttttaatctttaacgctggagttgtctttatgtcattggtttcattcaagctgtatcaaagctgggtcacgtactagaaagagggacaactaaattaagatatgcttgcccagagatgttaaaatgtaaaatgttttggggaaaacctcaacatcaaatgtagtttcttaagtatagaagttcttttctcatggtctttaagactatagagatttcacagatacaccaataccttctatatgtgctcagttaccttagagatgttaaaattggggcgcacaaagaaaagacctcagcaatcagaggctttaaagtgagacctcaaccatcagaggatttaaagctttagcttacaaaattttattttacaatcacaatcttccaatgatgtttaagctggatgagtaagatattattgctaaagttatcactcataattcagtggaaagtttgtgtcataccctattttgtgacacaattttaaagtatttatacattcaaactgacagtatgaaaaatacaagttttacctagaagatttctaacactagcaaattgacagtagtacgttatcaccaattgacctaaggttataaatgtatgtttgaagagatacatatgatgattttatttaggatttggacattttaagagatgcatgccagtgcccccagaaatctatcatagacttgttttacaagagtcacaacatacatgtaaatgtgtcttccctgttggagcctcattgaatatgtggaaggagagcttcatctcaaaaggaccattgacatgaaaactaaatggtatgacaaggtccttccagaaaacaaacccctttggatgggatcaaaagtggatccatgtcatacttgattacataccacagaagatcaagttatgctgaagcttcatgtttactttaaataacaagatgtaatcctaaagcagtccctttgtattgtatccattttatccataagtgttgatagttcctaattttcttcccattcatgttttgtcaataccggagaaggtcaaaatgataaaagaatgttaccctttaattctaccttttttcttaaattgaaatttctttgtagtgcaacagtaactacttttcttacactgtattataaacaaatgattataagtaaatgttgccaggataggagaagctatctttttgtattatatcctcctcattcgattttttttcaatctaaggaatatgcctattaaaacctcaatgctgaaagaattctgtgtttcaagttgagggaagctaaatttgttactttctgtgcattttcacaaacttaaatggctattggtgataggtgtatttttaatgccacttgttacaactaggaatttctcactgataattttagctaattgcatcatttattctgtacttgatttagtcaaatttttcttgtctttctaatgttctttaatgcctttttcattcatttagtcatttgattttttactctttcaatttttgtccaaagttagaaaatttttagagattataattttaaattatcacaaagacccctttgggttaagtggttatttttattttcccatgaaggttgtactttactaaactttatttttccattgcttaatgtctagtttttttaatatgagtctcaaaaagaacgtttattatttagcttggattagcttgttaaaaagagcacagttagtagagagaaatatgctgaatatatcaaatatttacaatgagctttacttggtacaaggcatactgatgagccagatggtatttccatgataaaccagttgaaatattttctgtgacttaccagtcaataaaataacaagccagatgagttaagcaataggattgactaatttcttttttctctgaagtagtattttttccaaccagttcaattaattgaaccagcttggcataatcaaacttgttatgtatttaagcatatttaagagtctttcccctctatgtatgtgctaatttaactaataacattaactgatgacattgataggaactgtttgctaaaaatagaaacctagagaaatagcagtttgaaggaaattgagggctaataattacatttcttggaagggaaaagacacaagtaccctaggtagacaattctggtaatagtccaggcagaataaaatattcccttggtcattacctcacacttcaggtgtatgtattttaaaatatgcttgtaaccattgactactactatttccttccctcctttttgtttggggagaagaagggtaggtactaaccaggaaaaattatctttagttctgtagatggtaaaagtaaagaagagaagtcctcaaaatagaaatagtgactccaggcgagaggaaagacaataaaaatttaagtttgattatgtttaaatgcttatgtttttagaacttgattttaagttcatttacagtgttaggatattttaaagtcagaaagctattagagcatttaaaaagcatactgaatattagtttttctctcacagtgtatctgtttcaaagaattggagaataatattctgttaagtgaatgttttctttgctacatttctattatggtgaacttttggtcagatttattgtttagcatcgtctgtatttaaaaccaagatgtcctgacagagaggaaaacagttataaacagagtcacatcacagtgactgtgtgtatgtattgttgaatctgccattcaaggatttgttgtagaggcatgaaatgcatccttagaaataaaatagttatttatttccttgggatttatggtattcatcagtacaggtgactcctatgattacctgtataatctcaggatttcccattgcctcaagttttgtttctaaaagacaggaatagttgaactggaccctattccaaaattagcatagtaaaacataatctttactgtgtaattttataatagcttacaattcttcaattaacatgtaaaacttctgacctttttaaaaatatcgtataaggtggaatattgtaaactcccaaattacattatcattccttttccctttctctctctctttctttaatttctacttcactacattagaatttaactgtcattttggtaggatgtatgatttcaagctattaaggtgagctgtataacagggaaggtcaaaaccgtgaactgagtcctaaattatgtagcctaccccagtgacttacattgtactttccattgtatttatgcttggctttttaagcgaattttgtttatctgtacaaaagtattgtcacaatacaaaatagttgtaatatgccactttttgagtgtctagcaatgcatattaaaacaatagaactgtgagtctatataaatatgctaagagagttttcatactggctaaaatggcaacatcttgtcatgtgaagatacagttcatttgtgatcattatttttgtgtttgtgattgcattaaaatttttatttttaatgtgttaattgtatacatagctaatcattaagatctgtaagataaacataaaacttgtgaattttagtttcacttcaggataatttcacaaaccactagattattttcaaatgctgtgaagcttggaattgggagtgctcttaagttaatgcatcctcatgtactgtttaattcagtatatatattatcttaactttaagaaaacaacctcctatttaatacttaaatacaggcctgaaaatgagatctatatatgcaactaaagattattttaaatgatagataaatgtgtgtgcctatgaatggtgaaatgattgtgttacataattaccatacttttgatgatgtaccataaaatggctttgagaagacagctatgcttattttgacagaaaaaatatgtctttctagcaaatactctcgtattggcctttcatactcccacttttgtaaccttttctgagcatctgtaacattttactaacctagaaatatggtttatcttttttgggagaagatctgaaatagctttctcatacatcaatcaggatgtgagtgagctaattcttttgagttactcatcattattgttcttttaaaggtgggattctgacaaagttaatttaatttaaataagtttctaactgtgagataaatcttcccattttgaaacactgcatggtatttttgctttataaatagtatttcagtgtttatgccatagattaaggtgagttgggagtgaagtggaaacctttaccatactgtttgtttttggagattgaaaggaatatccatgtactaaataacatgtttcttgatttcagccaagttcaaaaactgcagaaatagataattttaaaatgataactatgtgtcattgttgttgttgttgttgttgttgttgttgttttgtgtgttgtttgtgtgcgtatgtattttctttttcattttaaccagcctcttatacctagaagtcccacaagcagcgttgccacgccttccagcaccatcagtacacccaccaaaagagacagttctgccctccaggatctctacattccccctcctcctgcagaaccatatattcccaggtataaaactatcacgttgtcctaggcagcttctagctaaaggtaaacctaacagcatataaactgcaaagtcaattctgaaggaacaccttgaatattttctcacagttaggaattctgaacacattctgcaaaatcattcccattatagagcatgcatgtttattaataataataataactaatttgtatataaatacttgctgtgcattaaataatttatactatctcataataggaaagaagaagaaagtaatattaaataataattaggattattttaataagtaaacaataagtgaggctgtttggctaaaaagccccagaaaatttcaggttactttgaagcatttcatacattttttttttaaaaaaagagaaagctatagataacttttatgctttcttaaatgtaagtaatgaggaagattttatttggtaatgatgatgagggagaatgtctttttcccctaataatcctgtgtctgaaatttttatttcattaattcattaatgtttctttcaggaagtagagtttacaagggaatgaattacccttaaagtctattttctagatttcttgaggctgtatctctatttcatttatcgattcttatttgaaaatccttgcagatgtggaagaatacagctttatgtcataatgcattcttcctaaaagcattctgatatccagccttgtgaaatacaaaaattatggaaaaggactagcactaaatggggatcattaataccaatcacaaaaaaacttgattcagtttttaaattagttctgcattcaaaaacaataatttaaggtctcttgttttcaagccataaatagtattaaatttctttcatatataaaagaactaaattccttgtgtttaatttccattattctttagtacacttagtgtttcagaaatctgtattctattagatatgatggtttactgacattatgtgatctaaatgctgcatggcaatatggtttatctgcaaatactgtgttgtcatctagtaatataactatagttagttttatatatattttagttctttgagaattaaatatagccattggaacataacttataagatatagtttactaagctggcatttcataaatctaatatataatttacagtcttgtgttcaatttacaagcaaatatacaaatccatccaatatcctactaaaatgctagttgcattttaattctgttaagacagtgtcagattttccacatatgcttgcatgaggaacaatgaaagtatgtgtgttccaaacaggaagtgactttttatgatttgtttacattttatttggaaagatttttatttcagagcaaataattatttaaaaggccttattcttcagagggctacatacacagataaacattaaaagattatttttatcaaatctctgtagttttaaaatgttctttcctcttgggtagtgaggaacttgttacaaagaaagtgtctcctctacagaaaatatttaaaatacacttaagaggacaaaagagtaaaatgatccagttttgtcttctgagtgtggtggacatattataaaggctatatattgaagccaataaaaagcttgaagatgctatttaaaaatattagagaatgtgaaattgaaatatcaacatagtgacccttgttttgtcagtattgcttgaaaactccatacttttctgtaaaattcatagtgtttactatatcactgcaactgattcttagttggtcagtgtataatttaacagaatattctaaatacattttgagtcaaattattacttacccagtcataaagtctttcgatattggagtcaggacaatccatgcatcaaagcccctttgaaccacagccttatataaatgtctgcattttctggcttgattttaagttgacagtcaaaactttttgcagtcgtgattatttttacagatacagccttggcacttttttcctattttcttattttgaagatgaatgtgatggacttagtttaattcctctgaacatttttccccatattaaaaaactttgtttatacaggataggcattttggtggtatgtgaacatatatgtttgatttggatggcaaataataaaacctctctcatctcaaaaagaaaacagacttgaaaaatgataggactagttttcaaattaggcagaatttttttcatgtggttatgattttttgaacacatttaatccagaaaaaaagttattgcaaaagtgcctttttctctaaaagataaaacactcatgtatgtgaagtgagtgaaatttggttggcattttattatatgtcttgtgactaaacacagtttcattatcattatatatagtacatttctgtacttaaccaaatttctttttctatgataaaaatgtagaatttataggtctttgaacaactatgacatttaagtactaatttctcctattaactctactgtgtgccattaaatataaagttagttcagtaaagcaatgctcttttaatgcttccttaaatcctttctagagcaaaggcacagatttattacttacgtgcattaacttacaatattaagaaaggtgtaaaaactctttacatcagaatgaattaacacactgagttctccagggactcatgacgtgaatatatacattaacacacacacacacatacacatacacacatttacatacacaatacatgtatctactcattctactgaaaagtttggttttgcttggtacttttcttaattcaacagtattttactgcattctatatagatttgttttaaaaatctaccctgttgatataaggtccctccttcatattattataggaaataccatccctttcaatttcctgccacaagatgtttccatataaatatagtatgtgtattaatagggctgaatcaccctctgatttcagctgcattaacattcatgtcacaagcctcatagcttgaggtctggtacattgacagatacgcataaccttactccagtgccacaaattcgttaaggctgcttccaagctagttgcagtctcaatttctttttgatagtggactaaccaggcaatttgttcaggaaaagttttcagcaagctgaaagaaaattctgcctggattttatatttatttccttcatgttgcctaagaactatctatatagttctattgtggtaataagcaatacttttattttagaaaataaaagagtaaattgtaatgtaaatggcaacaacaccttgtgatgggttaaacagataagaaaactcactgattgtcagtctggagaatgttgtttactactttctacatatttcaaatactgggaatatagttttctacatttggacaaacctaaacatttacacacagaagcagaaatacaggcttttgccagactggggctcatattttagaattcacattacttttataagctcatcaccattttataaggtataataggaattaattaaaaatttgttctttttatctgtcttgttataatttagtttattctatgaatttaagattttagtctcatcacttaacataaaattaaattgtttttctggtttgacagcatttattcatggcactgtttagggtaaccagaaacaattaagaacaaggaagaaatttaactaatggtccacaaggggggaaacattgcatttacattcatagtcatgttctagaagacaagcttttctgacaaaaagttcataggtaagcagtgaaacatgtcataaaataaacaagattcaatttaacaaatcacaaatggactatttctatcaaaatgggcttaatctgggcttaattacctattgcagtgtgtgagtaataggttttagggagcccataaattattagagatgtttttctctagaatcctatagaagaaaaaaatcaacttgccatcaccctaaatgccattcttaaactctatattttatcagattaccttctctcctcaagaaacattgatgtataatgaaattttgatatatccatttagaatgagttctaggaatatgtctttttactcttaaatgagatacgtagagtttgaatactgagaataattcttttaaggtttattttaaattaataacatgttgtttgaatttcttataatacaagtttatatcatgctaatttgattcctaaggctgcagtgctccttatggtagttcttaaatatatttctatttttaagcagtgcagatttttaccaagaatcaatcaggtaaactggcagaagaaaacattatacttaagttaacattactaccattatacctactgtcttgaacactaaaaacaatttatgtgctaaggtaaactggcagaagaaagcattatacttaagttaacattattaccattatacctactgtcttaaacactaaaagcaatttatgtgcaaaggtaaactggcagaagaaagctatatacttaagttaacattactaacattatacctactctcttgaacactaaaagcaatttatgtatgacatggtacagtgaaaaatggacttgggcaacagttaaaagtttcatggcctatttcaaattctgtcagttattagctgtgtaacattgaggcaagttgtttagcctttctgagactcaccattttgttttcagcaaaataagaataattacaaattgccctgtaaatctcaaagaaagtttgaaaaggtcaggagatatattgtatgggagtaaattattagtattttagaccctcggccatttactaccctaacatgtttctacatcttctcctttactctaacctttctttagggatgaaaaaggaaaccttccttgtgaagacctcagaggacatatggtgggcaagccagtgcataagggatctgaatcaccaaattcatttctggatcaggaatatcgaaagagatttaatattgtcgaagaagatactgtcttatattgctatgaatatgaaaaaggaagatcaagtagtcaaggaagacgagaaagcaccccaacttatggtaagagttcttcttttatgtttatataagactatatttctggcataggaatctcaatttcctttaataagtttttgggttgtgagagttacttaggcgcttttgaatctttataattgatctgtctctctcatgtgcttctaagtggaatttctacaatatgagacattatattaaaaattattctagattttcaaaagataagaaagaacagtaggtaacattgtagctcataatgatttataaaaatctttttagcatcacatgtatttcttgtgtgttagatgttgccagtttggaaaaattcaagtgtttttttattcttttttgtttttttaaatgaatacttactgttaacatgacttatttaaaataaaattatctccatattcctcagggattttaagaaatataattttctcgagaaattctcacctcagtttttgtattttttaaagaagctgtgaaatttatttgacattagagtggaagtggattttaaatagaatggattgaacatactgtatttaaggcaaaaatgggcttagagttatgatgggcacaggattgttttaatctttgattcatgaccgaaaaagtaacccagtcacaaatacttaaaattgttatagtatatctgaaagatttgcagataaagttgcttaaagtagtcaagcttgtggttcttctgcaagaataaatggatttaattgaaagtctctgctcctccctttccacttttcaaattaataatttttagcgaggagcttatactttgaggaaggacagcatccctgctaattagttcaaacttgatcaatgggagctgagcagaagcaaagttgtttttagctcctccattctattcctacacctcacttgtctgtcatggccatatgcctccctcctttggtctcaaaagagcagtcatcacatatcttcatatacatgtcttatttcctttcagctctttggtaataagtatgaaagaaaaattttccccaaaatgatgctaaagaataggaaccatacttatcttaccttgtgttattctctgtacatgtgctttttaatcataagaataaataatatattttaacataaactcctcaactacactactctagtggcaattaaactgttaagtattgaagatatttgaacctttacttttctcctctactatattgtaaacctacaatatagagtatagaggcctgtaatctttgctatccctacccttgccccatgaaataatatgaaattttttttcttattcattcattccacaagtactaattgactgcctattaccaaataggcagtaatgtatgtcaactcttctttctttgtgtcccagtattatctggctattttctacttgtgttgaagtagataattaatgtttaatttaagagaaattatagtcaccaaatgaaagtgattgattactgatgactttattttaaaaaatgtttactaagttcttactcgaatggctataaattggtagtcccttcggactacattttaaagcccctaatgccatcatgtgccacaaatctcccccgactagaatagaatactttttaaatattagaaaatttagatagcctataaatacttgacatctttttgtaaccaacttaggagaaaagaaatatgtacatacttaaaagagagaagtaagcagagttatttgtttcattcagtatggcttttaactttctaaaattgacacataataattgtacatatttatgggatacagagtgatattttgatacatatatagaatgggtaatgatcaaatcagggtaattagcatattcttcaccttaaacatttatcacttctttgttctgggaacattcgaaatcttctcttccagctgttagaaattatataataaattattgttacctatagccatcctatagcaccgtagaataccagaacttaacttctctcatgtagctgtaatttatatccattaaccaatctcttcaaaatccctctcccactcacccctcccattctcagcctccagtaaccacagttctactctctatgagctcaaagtttttagttcccactcgtgaatgcaaacatgcagtatttatctttctgggcctgatgtattttacttaacataatgtcttccaggttcattcatgttgcagcaaatgataagatttcattcttttttagagctgagtaatattctgatatatatatatatcacattttctttatccattaatctgttgataaacacataggttaattttaatatcttagctattgtgaataatgctgcaatacacatgggagtacagatatctctttgacatactgatttcctttcctttggacctatacccagtaatgtgaatgctgaatcgtatggtagtcctgtttttagttttttaaagactctccatactaattactataatgacggtaccaatttacattctcatcaatattgtataagagctcccttttctctgaatcattgccagcatttcttattttttgtctttttgttaataaccattctaattggggtgagatgatatctctttgtggttttaatttgcatttccctaatgataaacgacgttaagcatttttatatagcagttggtcatttgtgtgtctgctttcacgcaatgtctattcagatcatttgcccatttttaaataaaaatatttcttttattgctgttgagttgtttgagttccttgcatattctggatattagttccctgtcagatgaattgtttcctttgctctacataagacttttagtttgatataatcccgtttgtctgttttttttcttttgttgcatgtaaaccttagccataaaaatatttgcctagaccaatgtcctgaagtatttcccctgtgtattcttctagtagttttataatttggggtcttatatttaagcgtttaatccattttgagttgattgtgtacatggtgagagatagggttctagtttcatttttctgaatatggatatccagttttcccagccctatttattgaagaggctatcctttgcccaatgtatgttcttgttgcctttgtcaaaaatcacccggctgtaaatacggacttatttctgaatactccattctgtttgattgggctgtgtgtctgtttttataccagtgcaatgctgatttggttattacagctttgtagtgtaatttgaagtcagtcagtgtgatgccttcagctttgttctttttgttcacaaatgctttggctatttggggtattttatggttccatacaaattttggattttttttctatttctgtaaagcatgtcattggtattttgacagggattccattgaatctgtagattgctttgggtagtatagtcattttgacaatgttaattcttctaatccatgaaaatgtgatgtctttccattttttgtgttctcttcagtttctttcatcagtgttttgtagttttcattgtagagatctttcacttccttggttaactttatttctaagtattttttgtagctattataaaggggattgcattcttgattttttttcagatagtttgttattggcatatagaaacactactgatttttgtatgttgattttgtatactgcaactttattgaagttcttaatcagttctaagagttttattgtggagtctttaggtttttctatatataagaacatattgtctgcaaacaggaacaatttgactttctcttttccaatttgaatgccctttatttctttatcttatctaatttctctggttagcatttccagtactatgttaaataggagttgtgaaagtgctcatccttgtcttgttccagtttttagagaaaaagctttccacttttctccattcaatataatgttagctgtgggattgtcatatctggcctttattgtgttgaggtgcattgctttctaatttgttgagagtttttatcatgaagggatgttgaatgttattaagtggcttttttgtgtatctattgaaatgtttatatggtttttgtcctttattctgttgaggtatcacatttattgatttgcatatgttgaaccatccttgcatctctgggttaaatctcatttgataatggtatacaatcttttttatgtattgttagattttattttctagtgttttgttgaggatttttgcatccatattcatgagggatattggtctgtagttttcttttttagttttcttcttgttggattttagtagtaggctactgctggcctcatagaatgagtttggaagaatttcctcctctactattttttcggatagtttgagaatacttggtataagttattctttaaaagtttggtagaattcagcaatgaagccagcaatgaagtcatctggtcctgggcttttctgtgttgggatcatttttattactgattcaatctcattactagatagtgatctgttcagtttttttatttctccttgattcaatcttgatacattatatgagtccaggaatttatcattttctctaggttttctaatttgttggcttgtagttgttcagaatagtctcttatattcctttgtattattgtggtatcagtggcaaagtttcctttttatgtctgactttatttgggtaatctctgttcttagtctggctaataatttattttgtttacccttcaaaaaatcaacttttcgttttgttggtcttctgtaggttttttttttttttgtctctttcatttagttctgctctgatctttattatttcttttcttccactaattttgagtttgatttatttttgcttttctgatttctttttttcctaattttttgaagtgcaatgttggagtgtttatttgaaatctttctgcttttttgatgtaggcatttcttgctataaacttctttcttagtattgcttttgctgtatcccataggtttttgtatattgtatttctgttttaatttgcttaaattttttaatttcctttttaatttcttcattgacccattcgttgttcagaagcatattgtttaacttccatataatcgtacagtttttaaagtttctcttactattgatttctagttttatttcattatgatctgaaaagatacttgatagaatttcaatttttaaaatttgttgaaacttgtggcctaacgtatggtctatcctggagaatgttatttgtactgatgagaagaatgtatactctgcagctgttgaatgaaatgttctgtaaatgtctgttaggtccatttagtctatagtgcagtttaagtctgacatttctgtgttgattatctctctagatgacctatctaatgctgagagttgggtgttaagtccatagctattattatataggggtctatctctccctttagctctagtaaggtttgctttatatttctgggtgctcctgtgttgggtacatatatatttacaactattatattcatttgctgaattgattcctttgtcattatataatgaccttctttttacagtttttgacttaaagtttattttatctaagtatacctactgatgcttgatttggtttttgtttgcatgaaatatctttttctgtctttttactgtcagtcggtatgtgtctacaggtgaagtgagcttcttgtatgcagtatagagttgggtcttgttttttttttttttttctttaatccactcagccagtctatatcttttgattggggaatttaaaccatttacattcagggttgttactgataggtgaggaattactccttcatttaggcaattgttttgcttattctttgttgctttcttctctttttgttttatctttgcagtttggtggttttctgtagtgataaggtttgattcatttatctttgtcatttgtgtttctactctaccagtgacttttattcttttgtgtgcttccatgatggaaattactgtctttttgcttatagatgtaggattcccttaagtatttcttttaggcctggtctagtggtaatgaattccctcagtcttttcttgtctgggaaagactttatttctccttcattgctgaatcatggctttgctcgttgtagtagtattagccaacaatttttttctttcagcactttgagtatatcatcccattctttcttggtctgtaaagtttctgctgagaaatccactgttattctgatggaggttctttttatgtgatctgacacttttttcttactgtttttaaatttttttctgtgtctttgacttttgacaatttgaatataatgtgatttggagaagacttttttgggtttgaatctgtttgcggttctttgagcttcctgtatgtttgtatggtatatcgcttgcaaaacttgggaagtttttagctcttattttgttaaatagtgtattagtcagggttctccagagggacagaactaataggatatatgtatatatgaaagggagtttatgaagcagaattgactcacacgatcaccaggtgaactcccacaataggctgtctgcaagctgaggagtaaggaagccagtagtggctcagtccaggtcccaaagcctcaaaagtggagaagccaacagtgcggacttcagtatgtggccgaaggcctgagagccactggcaaaccgctgataaaagttcaagaatccaaaggctgaagaacctggagtctgattcaagggcaggaaccatctagcatgggagaaagatgaaagccgaaagactcagcaagccagcttattccacctccttctgcctgctgtttctagccatgctgacagccagttggatggtgccacccacattgagggtgggtcttcttctcccagttcactgactcaaatattaatctcctttggcaacatcctaacagacataccttgaaacaacactttgaatccttcaatccaatcaaattgacacttaatattaactattacaaataggttttctatgcctttgcccatttaatttacttctggaacacttaaattcaaatgtttggtcactttatggtgtcccatttgtcatgtagagtttctttattcttttttattcttttttctttcttttatctctgactggattatttcaaaagacctgtctttatattcagaaattccttcttaagcttgatctagtctattgttgaagttctcagttgtatgtttttatttcattcattgaattcttcagttttaagatttttgtttggttcttttatatgatatctatttttgttgaatttctcattcagatcatgaattgtgttccttattttgttgaattgtctgtattttcttatatctctctgagtttccttaagatcattattttgaattgcttttcaggcatttcatacagtttttttttcctttggtgtatattgctagagttgtgttcctttggaagtgtcatatttccttactttttcatgtttctcatgaccttacattgatatctgtgcatctggtgaagcagtcacttctttgaattttgtgggtttgctttcacagggaaagacatttttctgcatttgcattctatagtgtcaattgggtagggtgctttgtttgggttgtgtgtgtgtgcacagtagtgtaatctccatatgatatctttgtctatagtcactcttgtattctccaaagttttttttttaacttttgaaactgaaacaaatataaccttaatgtagatacttgtagatacttcactggagattcctcagtacaagaactgaagattgtttcaagtaaataacagtttaatgtatttacctttttaaaattaaatgttaaataataaaacctatatgtcaggcacaggactgtgtggccctaattttcccaacaatttatttgttaagtcattcaactaatacttgtatacataaagtcagccagccactgggacacaaaaatgaataaaaccataaatcctaattacccaaagggaagaaacaaataaatagatgcatcacagtcacttcaggtaagttggaaggtgtgcaccaagtgctgtagtagcctaggaaataaagtctcatagtttgccttggaagtcaaatgagtacacatgacatttatgctgggttttaaatgatgaatagcgatttcatccagggtttttaaatgctagtcatcccaccaaatacctggtaccttctcaagcctatgtctgagatctgaagatttgtctaaatatctcagcccagaccctaacgaccccaacagaaataacttcaaaccttcataagcaataatcaatgacaacttttttatttaacctataaaatagtcccattacctggactcccaagtgcgacaatattatcttgtatttgaaaataatgataacgaaagtatgtaatcctgcttaaatatattgtttaaaaaaaaactaaagtacaaaaaactacatacttgacattttctggaaataatggtaatttaatctcttagcacttgtgtgataccttaaaatgcactatgtaagtcttttatccttagagtgttcaatttctgttcttggtcacaaaaacccttaccttgaagtatgtgaatttagctaccacttctttcctattaacttcccagatcatctgtttactcaaagagactttagagttaagattataagaatatgggtaggattttgagaagcaaaagcgatatgacacagttcttcatatgtgctttcagttgaatgtgtatgtagttgctatattttccttgtacattcatattctaaatttagacatctaatagaaaaatagggacactctgttattaaacacagtgacaaagaaacacagatgtaaagaaaaatatttgaaaatatctggttgttttttttttttgagatggagtcttgctctgttgcccaggctggagtgcagtggcacgatctcggctcactgcaacctccacttcccgggttcaagcgattctcctgcctcagccttccaagtaggtgggactacagatgcacgccaccacgcccagctaatttttgtatttttagtagagacgtggtttcaccgtgttggccaggatggtctcgatctcttgacctcgtgatctgcccacctcagcctcccaaggtgctgggattacaggcatgagccaccacgcccggcctgaaaatatcttaatagtagcttttaaagtatgttatttaacgaagattcttatgttataccatggaccctctagttgttaagaatgagttaaaagaagtacaggtatttaccctaagcaattaaacaaatacagtatggactgacagtagatggcatttctagaaaataagtaaatacaataagccctcatttaacatcatctacaggttcttggaaactgggactttaagcaaaatgatgcacagctgatcccaatgccatttccttcaatatcattttgttataacaatgaggaagaagatggttttgtaatctgtggtttcactttaagtcccagtttccaagaacctagagacaacattaagtgaggacttactgtaatacctgttgagcgttcaggtatgccaaacacagttctaagcatttaaaagcattaatctatttaatcctcacaacaactctatgaggtatgtactaataaaatatttgttttacagatgagaaatctaaaaaacagaaaggttaaataacttacccaactagtaagtgatagagctaggattaagtactcatggatatttttttgacccttaccagtggtaatgctagctaaatgtgatgaaaataattttttaattgtaggtaaataatttccaaaaattacattcctcgttctaaattcaagaatttgattccagcaagcagaaccaagtctgattttatatgttcttgtgtatgttgttttggatttactaacactataacgagcatgcatttacatagatatgaacctgacaggccttaggaaaagactgctaaatttagatgtaaaatgagcaacaatgtgttatgtcctttttaaatcagagagtataaaataggtttactttcctaaaaagatagacaggaataacttatggaaacatggataccagtagcagaagcaatctagattagtagttactagcattggctgtagcatcagccatagttggtaattttgtctgccatctaattattccagtgtgaccttggggatgttactctgggcctcagttttcttattaaatgaatatgataatatctgccttgtagagttttgtgagatttaatggtaagacattgtaaattgcctcagtgcccagtatgttgggtctttgttttcattattatcattattacatagaagctttaacatggaaatagaaacagggaaaaggtggcattaaatcattttaactatatagggtctcattgctcaggcttcaaaggcaaaggcttaaatttgatgagatcagttgcttggcaacttttcaaaatggtaatatttcccatcagcttttccatcttgctgtacatggactccttgcccttgctatttcatcataacacatttctatgcatagaaacatgctaaaaggtagacacagttggctgagtccctttgtggccatgaatggtcatattttataagaataggaggaaaacatatcttttaacaataatatcaccaaatagtattggtttgaaggtaggaatccagaccttttctgatttattgaaaatccaggacctcacaaaaagcacaggaatgaatgtaaagctgatattttagaaattatcctcataaatgttacttgtacacattgtgcattgaggaaaattaatctctgtaacattatacctgaacattttctacctgagtagttgggacaagagaaaatcaaatactatgtcctttttatccacataaatagcaaacggcttgagtgacatatagcagtatgatgaagggcctatgggcaatgacatcataaactgagttttatcaatgtgaagttaggatagcgtctgtaggttccagggtctctctgtcctgtgattttaaaatgtaaataatcttccttatcaggtaaaagttcagctgtcattaatcagctattctggagacaaaagaaaataggattctacccatgggaaatttttgtgttcaagtaaaatgtacgatttccaaagaagaactaaccacagaaatagaaattagtgattcaaagatgaagaaatgtgggatgtgcactatattcatgggaattcttattcctttagacttatttaataaagttcataaagactacatgttggttagcctcacaaaataatttttagcatcaagctgatggtggtaaggaaccatgtaattgatggaaaagcagttcaacaatattttgacatagaaagtagtctgtttctattgtaaaacttggagaaatcgtctaaggaaggcattcttcctgaatttgtgcaattttactgatggaaatggaagagcatgaattatgaggtcaaatagacttgaatttgctatcacagcttggcttttaatagctaattgaccttgagcttcagacttaacctccctgtatttttgtttccctgtctgtaaaatggaatagtaatattactcatggtgtttttttatgaggattaaattagataacatacgtcaaatacttagaagagttcttttttttcttttcttttctttttttcttttttttgagacagggtcttgccctgttacccagtctgtagtgcaatggcatgatctcggctcactgcaacctccacctctcgggttcaagcaattctctgcctcagcctcctgagtagctgggattacaggcgtgcatcaccacgcctggctaattagcagagttcttgcctcatagaaagtactcaagaaatgatgccttagatggtataataaatgcttgctgctcataaataaaaatgtcccaaagatttttcaagtctcctgtggaaggacttagttagtaaaggacaaagtatctagaagtctttccacatgtttggtcactctaccaagccaatagctggccatttaaattatagcagttaaatatgagtagagctttttggtttcttttggtttgattttgcaaaccaaagcagaaggaagatctttcaaatagttaataacactgcaaactgccctcatccaaatcctcttaagctccagtataaaaatcatcagctcacatgctggattagaagggcccagttataatctctcagcgtcaggaatctgaaaacagttcagcccccacatctttttaaagtttttgattagttgcttaaaaaatggaagaatagtatattatataaaataaataaaatggttggagagccttaaagaaattaaacctaggaagaaaagattattctgaaagaattcaaggtactaggtaatggataaaacagtaagattaagaaaaagaactttcggtggctggcaagatggccaaataggaacagctccagtctgcagctcccagagggatcaatgcagaaggtgggtaatttctgcatttccaactgaggtacctggctcatctcactgggactggttagacagtgggtacagcccgtggagggtgagcagaagcagggtggggcgtcgcctcaccctggaagcacaaggggtcggggacctccctcccctagccaagggaagccatgagggactatgccatgaggaacggtgcattccggcccagatactacgcttttcccatggtcttcgcaacccacagactatgagattccctcaggtgcctacaccaccagggccctgggtttcaagcacaaaactgggcgactgtttgggcagacaccaagctagctgcaggagttttttcctaccccattgacacctggaatgccagcgagacagaaccattcactccctggaaagggggctgaagccagggagccaagggatctagctcagtggatcccaccccgacagagcccagcaagttaagatccactggcttgaaattctcactgccagcacggcagtctgaagtggacctgggatgctcaaccttgctgggggaaggggcgtccaccattactgaggctttagtgggcagttttcccctcacagtgtaaacaaagcctctgggaaattcgaactgggcggagcccaccacaacctcggcaaagccacggtagccagactgcctagattctcctctagattcttctagtttcttcctctagattcttcctctctgggcagggcatctctgaaagaaaggcagcagccccagtcaggggctcatagatagaactcccatctccctgggacagagcacgtgggggaaggggtggctgtgggtgcagcttcggcagacttaaacattcctgtctgccagctctgaagagagcagcagatctcccagcacagcgctcgagctcagctaagggacagactgcctccttaagtgggtccctgacccccatgcctccttattgggagacacctcccagcaggggttgacagacacctcatacaggagagctccagctggcatctggcaggtgcccctctgggatgaagcttccagaggaaggaacaggcagcaatctttgctgttctgcagcctctgctggtgatgatacccaggcaaacagggtctggagtggacctccagcaaactccagcagacctgcaccagagggacctgactgttagaaggaaaactaacaaacagaaaggaatagcatcaacatcaacaaaaaggacatccacacaaaaacctcatccaaaggtcaccaacatcaaagatcaaaatagataaatccacgaagatgaagaaaaaccagcacaaaaggctgaaaattccaaaaaccagaatgcctcttttcttccagaggatcacaactcctcaccagcaagggaacaaaactggacggaaaatgagtttgacaagttgacagaagtaagcttcagaagatgggtaataacaaactcctgagctaaaagagcatgttctaacccaatgcaaggaagctgagaaccttgaaaaaaggttagaggaattgctaactagaataaccaatttagaaaagaacataaatgacctgatggagctgaaaaacacaacatgagaacttcgtgaagcatacacaagtatcagtagcagaatctatcaagcagaagaaaggatatcagagattgaagatcaacttaatgaaataaagcgtgaagacaagattagagacaaaagaatgaaaaagaatgaacaaaggctccaagaaatatgagactatgtgaaaagaccaaacccacatttggtcttgtttggtgtacctgaaagtgactgggagaatggaaccaagttggaaaacactcttcaggatattatccaggagaacttacccaacctagcaagacaggccaaattcaaattcaggaaatacggagaaaaccacaaagatactcctcaagaaaagcaacgccaggacacataatcatcagatttaccaagtttgaaatgaaggaaaaaaaggttaagggcagccagagagaaaggtcgggttacccacaaaggaaagccaatcagactaacagcagatctatctgcagaaaccctacaagccagaagagagtggggggcaacattcaacattcttaaagaaaagaattttcaacccagaatttcatattcagccaaactaagattcataagctaaggagaaataaaatcctttacagacaagtaaatgctgagagattttgtcactaccaggcctgccttacaagagctcctgaaggaaacactaaatatggaaaagaaaaactggcaccagccactgcaataatatacaaattgtaaagaccatcaacactatgaagaaactgcatcaactaatgggcaaaataaccagctagcatcataatgacagaatcaaattctcacataacaatattaaccttaaatgtaaacagactaaatgccccaattaaaagacacagactggcaaattggataaagagtcaagacccgtcagtgtagtatactcaggagacccatctgacatgcaaagacacacatgggttcaaaataaagggatggaggaatatttaccaagcaaatggaaagcaagaaaaaaaaagcaggagttgcaatcctagtctctgataaaacagactttaaagcaacaaagatcaaaaaagacaagggcattgcacaatggtaaagggatcaatgcaacaagaagagctaactatcctaaatatatatgcacccaatacaggagcacccagattcataaagcaagtcctgagtgacctacaaagagacttagactcccacacaataataatgggagactttaacaccccactgtcaatattagacagatcaatgagacagaaaattaacaaggatatttaggacttgaactcagctctggaccaagcagacctaatagacatctacagaactctccaccccaaatcaacagaatatactttcttctcagcaccacatcacacttattctaaaactgaccacataattggaagtaaaacactcctcagcaaatgcaagagaacagaaattataacaaacagtctctcagaccacagtgcgatcaaattagaactcaggattaagaaactcactaaaactgcacaacaacatggaaactgaacaacctgctcctgaatgactactgggtaaataatgaaattaaggcagaaataaataagttctttgaaaccaatgagaacaaacacacaacgtaccagaatctctgggacacatttaaagcagtgtgtagagggaaatttatagcactaaatgcccacaggagaaaatgggaaagatctaaaatcgacaccctaacatgacaattaaaagaactagtgaagcaagagcaaacacattcaaaagctagcagaagtcaagaaataactaagatcagagcagaactgaaggagagacatgaaaaacccttcaaagaatcagtgaatccaagaggtggttttttgaaaagattaacaaaataaaccactagccagactaataaggaaaaaataaagaagaatcaaatagacacaataaaaaatgatgaaggagagatcaccactgatcccacagaaatacacactaccatcagagaatactatcaacacatttacacaattaaactagaaaatctagaagaaatgggtaaattcctggagacatgacaccctcccaagactaaacaaggaagaagctgactccctaaatagaccaataacaagttctgaaattgaggcagtaattaatagcctatcaaccaaaaaaagcccaggaccagatggattcatagccgaattctacctgaggtacaaagaggagctggtaccattccttctgaaagtatcccatacaatagaaaaagagggactcctccctaactcatttcatgaggccagcatcatcctgataccaaaacctggcagagacacaacaaaaaaagaaaatttcaggccagtatccctggtgaacatctatgtgaaaatcctcaataaaatactggcaaaccaaatccagcagcacatctaaaagcttatccaccacgatcaagtcggcttcatccctgggatgcaaggcttgttcaacatacccaaatcaataaacgtaatccatcacagaaacagaaccaatgacaaaaacctcatgattttctcaatagatgcagaaaaggcctccagtaaaattcagcaccccttcatgctaaaaactctgaataaaataggtattgatggaacgtatctcaaaataataagagctatttatgacaaacccacagccaatatcatactgaatgggcaaaagctggaagcattccctttgaaaactgacataagacaaggatgccctctctcaccactcctattcagcatagtattggaagttctggccagggccatcaggcaagagaaagaaataatgggtattcaaataggaagagaagaagtcaatttgtccctgtttgcagatgacatgattgtatatttagaaaaccccatcgtctcagtccaaaattgccttaagctgagaagcaacttcagcaaagtctcaggatacaaaatcaatgtgcaaaaatcgcaagcgttcctatacacccataatagagagccaaaccatgagtgggctcccgttcacaattgctactaagagaataaaatacctaggaatacaacttacaagggatgtgaaggacctcttcaaggagaactacaaaccactgctcaaggaaatcaaagaggacacaaacaaatggaaagacattccatgctcatggataagaagaatcaatatcatgaaaatggccatactgcccaaagtaatttatagattaaatgctatccccatcaagctaccattgactttcttcacagaattagaaaaaaactactttagatgtcatacggaaccaaaaaagagcccatatacccaggacaatcctaagcaaaaagaacaaagctggaggcatcacactacctgacttcaaactatactacaaggttacagtaaccaaaacagcatttactggtatcaaaacagatatatagaccagtggaacagaatagagggaggcctcagaaataaggccacacatctacaaccatgtgatctttgacaagcctgacaaaaacaagcaatggggaaaggatttcctatttaataaatggtgctgtgaaaactggctagccatatgcagaaaactgaaactggaccccttccttacaccttatagaaaaattaactcaagatggattaaacacttaaacgtaagacctaaaaccataaaaaccctagaagaaaacctaggcagtaccattcaggacataggcatgggtaaaggcttcatgactaaaacaccaaaagcaatggcaacaaaagccaaaatagacaaatgggatctaattgaactaaagagcttctgacaggaaaagaaactatcatcagagtgaacagtcaacctacagaatgggagaaaatttttgcaatctatccatctgacaaagggctaatatccagaatctacaagaaacttaattaaacaaatgtacaagaaaacagccccatcaaaaagtgggcaaaggatatgaacagacacttctcaaaagaagacatttatgtggccgacaaacatatgaaaaaaaagctcatcatcactggtcattagagaaatacaaatcaaaaccacagtgagataccatctcatgccagttagaatggcgatcattaaaaagtcaggaaacaacagatgctggagaggatgtggagaaataggaacactttgacactgttggtgggcctgtaaattagttcaaccattgtggaagacagtgtggcaattcctcaaggatctagaaccagaaatagcatttgacccagcaatcccattactgggtatatacccaaaggataataaatcattcttttataaagacacatgcacacgtatgtttattgcagcactatgcccaatagcaaagacttggaaccaacccaaatgcccatcaatgatagactggataaagaaaatgtggcacatacacatcatggaatactatgcaaccataaaaaaggatgagtttgccgggcacaggggctcacgcctgtaatcacagtactttgggaggcagaggcgggtggattgcttgagctcaggagttggagaccagcctgggcaacatggtgaaccctgtctctactaaaaatacagaaaattagccaggtgtggcaggatgtgcctgtaatcccagttgcttgggagactgagacgggagaatcacttcaacctgggaagcggagattgcagtgagccgagaccgttgcactccagcctgggcaacagagcaagactccatctcaaaaaaaaaaaaaaatgagtttatgtcctttgcagggacatggataaagctggaaaccatcattctcagcaaactaacacaggaacagaaaaccaaacaccgcaggttctcattcataagtgggagttgaacaatgaaaacacatggacacagggaggggaacatcacacaccggggcctttcgggggttgggggactaggggaaggatagcattaggagaaatacctaatgtagatgatgggttgatgggtgcagcaaaccaccatggcacgtgcatacctatgtaacaaacctgtgcattctgcacatgtatcccaaaacttaaagtataatttaagagaaagaaagaaaaatcacttttaataaagttcggtggtattcatatgtagataaaatagaagtattagcaaaccaaatcaacatagctgatgcaactatgaggggggaaaaaaacctcttcagatgaattaatcgaaaagatatgaactagatgaaatagtgttcccttataaacagaatgggaaagccaagaagagaaacagtctcactcagtgattctctgggttcagtattgtcccccaggggacatttggtaatttccggggacaattttgttgtcacatttgtggtggaaagttgctactggcatctaatgggtagagaccaaagatgctactaaacatcctgcagtgctcaggacagcacccaacaagaatgatctggcctgaaatgtctgagaaaccctggctaacttaagaatcaatttacaaataaattgaatacagaagcagatactagaaaatcaaagtcagagaccttgtatggcacagaggtgattgccttatatttttttaattgaaagaacctgggaagttactgccctggaaagatataccaacatttattcacagttagtatattctctggacagaagtattcatttaaggttgttagcgtcagggattacctagcctgttctacaatagataatctaatcatgacatcccctggagcaggagacaatacgtttatccctagtcgaaatccgaatacattttcccccatgagaaaaaaaaaaaaaactataataaatggtagctaggtaaagtttaaatagggctattcatgttagctttcagatcacaatatgacttaagtaatccagcgatttcctaagtacgttcttcagatcactagttctgaaagatagcctatggaagaaagaggttatatggttaaataagattgggaagttttacatattttaggcccctcttggagattaataaattcacattcacatactacatctttgaaagttttgttgaatttgggttaatttactgtttcccaaatgtgtttgtatattaaatcccttttttggtcacataatacttaccagcttcccaatggaactaatgttttatggaatgtattttggaaaatattgtaaaagacttttgcagctcttcttaaagacccaactaccaatgatacgatttctttgtgtcttaagttccaaacagctgacttacagataagcatatagaacaacctctgttctcaatatttaagcctgcccagcggttggattattgaatgtcatcttcattcttcattcttatcttgtagaaaagccatatgtaaactactttctagagtaaatcttatttatgatgaaagttcaaactaaagtaagaaaaactatctagaaagatcattacatggtgttctatacttcaagccacttgtggaattactactatcactgcaaaacaatttgccagaagtcatggaagaaatagatccttggggatagaaaatgtcaggtgtaatattcagtgttcaaaaagagataagtaaaaattacacactgaataatgactggagacattagagcaaataattaaaacagtatacagccatttaaaaatgtacatatgacaacttagcattgttttataagcaacacatcatgtcataccaatttatttgccatcattgttaaggtattggaccacaaacaaaaagttgcatccacagtttatgctgtaatcctccactagttcttcacatagccttagtattttgcaagagttgcaaactggctgtgaggacacttaaacaaacaaaaaaaaactaatcatacatgccattaaatttttgaagaaaaattaattggatttttgtctaatgtaatggtcttgaatgatacatcactgaggcaatttgatgtagtgaaaagaggtctgggataggaacttgaaagtctgtattcatggactgactctaagtgtttattaccctgaaacttctttagttttttttcactgaatatctgtgaaatcagattatctgtgaaatcagggagaggatgagggtgaagagtattaacctgtgtgctgtacttttacactccattgtcttctaattgtcttatttttgttctgtgaatgtgtccattagggtcctacattgtcaataaaagtgatgtttccattacaaaaaaaaaaaaactttggtctgtctgaagtttttcatctctacctttcttgctggcttcactaacaagtaatggtctcagaaaaataggtgaaaggaattgtaaagttattacaagatgtcatttattttcaaataagaatgttcaactagttaccttattatctttttttacttttcatgagagtgactgtcttccatatgctgataggatttgcaagacacactgctttactaaaatttttaaaactagactgctttaatttgcagttctttaacttgagaactgcatgcttttaaccaataatatttacatgcctgtgtcatctttcttgttcacatttatatcaatgctgagcacagcaaagagacaagtattttagcctagctcattttataccaaccagagccttcagagtacccagaactcttttgccacttaaacagtatttaaatcatctaaatcctttctcattcctcccacacccctctaatgtagagaaattgtctctatgaacagagacaacatttcaactatttcagctatttcaacagatttccaaactccaatgtgtatgtatagcttgttccctcttgtggtggaatacttacaaaaggtaatttggttcaaaatataattagccttggaattaggtgttagaagtgccgcataattttttgacgcagttcagtattttctcctttagcaattctttcatgttattccccatttaaagtatatatcacttttagaaagcagtaggaaaatacacaaccacaatggagcttattcttggaaatgatttttttaactttaagtttaggggtacaagtgtgggattgttacataggtaaacctgtgtcatggggttagttgtacagattattttatcctcaggtgtttagactagtacccgttagttgtttttcttgatcctctccctcctcccaccttccaccctccaaaaggctccagtgtatgttgttcccctctgtgtatccatgtgttctcatcatttagctcccacttgtaagtgagaacatgcagtatttggttttctgtttctgtgttagtttgctgagcataatggcctccagctccatccaggtccctgcaaacaacatgatcttgttcttttttatgaccacatagtattccatggtttatatgtgacacattttctttatctagtctatcattgatggacatttatgttgattccatgtctttgctattgtgaatagtgctgcaatgaacatacacatgcatatgtctttataatagaatgacttctattcctgtgggtatatacccagtaataggattgctgggtcaaatagtatttctgtctttaggtctttgaggaattgccacactgtcttccacaatggctgaaccaatttatactccaccaacagtgtataagagttccttttttctttttttccacaacctcaccaacatctgtctttctttttttttttttttactttttggtaatagccattctgacaggtgtgagatgatgtctcattgtggttttgatttgcatttccctaatgattagcgatgttgagcttttttccatatgattgttggcagcatgtatgtcttcttttgaaaagtgtctgttcatgtcctttgcccactttttttatggggttattttggaaatgagattttaactggttttgttctctgtcaatgaaactgaaaagattttaaattaatcaatacaaagtttatatttgatttgtattatttataagtcattaaaggtaatccttaaataatcctcacattgaaatgtttacaaaccaatttcttcagcctcttttatccagaaatgaaatttttaaaatatgcctataaagatcagatcgttcattcttattttactggatccagatatgttaccattatcctttaaaaattactgactttccatttaattcagttttacttcctctttaaatgtgtgattctctaccttaaataaccccaggatgttttcctagaaattcagtcagccatctgaaagtaatttttctgtctggtatgtggggtttttgatgggtgtatgtggcaagcatatagcttaactatactcactatactcattttcatcaaaatattggctaaaatattcagaacagatgtatatatgtgtatactttttctgagactctagagaaagcttttttgtgaacattaaagggcatgtcagacttatggagaaatttctttgaaaatttttttaaatctttgacaactgtaagagaagattgcttctcaggtgctgtttattaccctgaaacttaatgactttagcgtgcttttagagagtttttaaaagcgatacaaatgaaaaaggcagcaattcagtggtgtttcaacagacaacatgggaatgtatgtagataagaaatcaagagacagaactagttctgacttgattggcaaacagttctgtaaagctcagtttgtcagaaaaatgaagagtattggtgagggtaacatacttgccttagaaggaaggaagagggaggaaaagaaggaaatggaaaattagaaggaaggaaagggaaagaaactacgaaaatagaaactaatgatacagcttggatcctttttggtctagtgtctgaggaaagtcccctatttactttcttaacaagcagtgagttaaatattgagcagttactgtgtttaaggtactgcgctaagtgtgggagataccacagtagacagtagaaaagtctgtcttctcccatgaagtttacagtctagaagggtgacagaattcaagtaactaaattaataaatacttacgtgactataattgtcatgctacaaagaagaactttgagaggaaatgagacaaacacagagaatcctgacctagaatgagaggccaaggattgtatccctaaggaaatgacatttttgcttagctctgaaggatgcatgtgaatttatgataagaagagaggaaaatcagaagacagagtcttagggtgccgggtaaggaaagtgtttcaaggaaggagtagtactcggtgctaatgctacagatacatcagaaaagtcaaggactctgagaattgtgtattggatttagcaacatggaggccctaaaaaccttgacaatagcagttttggtggaatagtggggacaagagcttaatcggggaagattcaagaggggaggagaagaattgggggctacaaatataaagaagctttctacaaggttttctgtaaagagaaacaaaaaataaggtggtagctgggtagaggtttgtggggtgaggagagttactttttaaaaaacgattggagaaattacagcatgtttatatgctaatgggaatgactgagtagaaagagaaaagttgatgatgcaggagaaagaagggaggattgctcaaggcatgcccttgagtaggtcggagggaataggatccaatgagcaacccagtaatttcagatctccctaatgtcacaatacagtataataagtattgtatatatgctaaaggcactaggaaaaagcttagggagcccagtagagtgagcagttaactctgccaaaggggattgtagcatttgtgatatcacctaaaatgcttatctgaggtaaaaattagtttattttcaagcaatgttgtacactagcattaaagcatagcaattttgtattaaaatacagtaattaggatatatcattatacagcacttcatcattgtctatattcttaaaattgtattttgtgttacatttgcttaattgcgctgaatatagtccataattcttaaaaacctacttgccatcaatatcataataaaattcagacaaaatccaaaaaatagttatctttttttctgtgtgcctctataaaaatatttatcttttacctttaccacatttattagaatacaggaataaatacagcacaaaatttctgcctctatggagacaccaattaaaaaactctagatgtgcaacagatattaaaagccaaataaaataatggttatactatgaggcactagcacagtggtatcacaaggcttatgatagggtgccaaatgaactctgcaattaatgcatgctttatacttaaaggaataaaaaattaagaagtggtcagcaaaaatatttaaatgggccctaatcctcgttttctagattatattctttgctgttattattcttatcatgaattagtaatcttaactttacaacttcaaaaaccaatataagtactactatgtaaagatatgtcttaaacttttccagattacttttcagagatttatgttttatttatgttcatttacacaggaatgggtcagatgtatttaattttattaaaccaatccatttgtattaaagccttaaaaagtcatatgagtataaaaatactttgcatgtattaataatagcatatatttgatttaagtctataatgcttatagtactcttgcctttggtgttttgtttcacttggttttttaccaacagcactaaaacattgaatcatagatttatctttccatttgaactttgctgtcctgtgaaattaaaatgctgctgtatacatgcagtagcaaacatattttcaagctgtaatcaatgatctgtatatttggaattagaaataatttaagccatggtctatttttcagtctgccatggactgctatttatacaagaatgttaccttatgttattggtttaactgctttattaagtcgacttcagtatttcagcacaattaaaaatcaatacttataagcaacattatttgttctacctaaatcaataatatactttattttttaaaatacttatttttatttgcattgctgaatctatggttttataactaataaaagcaaaaccttgatgttctccaaaagtaaatttcagtaaagctttttctttcggtttttttctaatttagtatattttccttcaattgtgtattagtaatatacagtataattctgttaaaaaaaaaaagtcacccccggaaaagtcagtgttaaaaatcttctgcataattgtttctatggctaattatacaaccagacatatcaagggcttaattacatgcttcaatgacttagctccattaaaatttcagagatgacgcaaaatataatgaatacaattatgtatttcatattctgtgtgtgaagtatgtttcttcttgtttttgtgcacatatgtttgtctccaaacaaccaattttcaaaaaatatctaactagctttttaatatatataacatatagagcaagtgaaacaactgcttatttattggattttcacttttcaaaagattttttgatgacatgtaaaaacagtgctagagctgttaattgcttcagtttcagtgcccatgctgaagtagagtttatttctaaaaccagatcctaaagaaataaattgtagatattttgaaaatacagccttcataacattgaaaatctggaggactgactgtgcaaagtggtgggaatagacataacaaaaggagaccttccctcaaacctttaccctactttcgatgggcagaatattgacctggatctatagatggctgttgtgagacctcggttcttcttagcttaaaagaatttaaacaagagacacacagcaaaggagatatagtatagagcaatttattgcaaaggacaaagaatattatgaaagttaggttcagaacagacagtacaccctgagagaggattcagggtgagctgctcctaaggatgagaccaccaagactggcactagggagactccctttatgagagtcttacataattattcataaaggagtgggaagaggtgttgctattaagcatattcttggttgtcctctgggtgcacatgcatagtagctgtacatacttgttcatacattgcatgtctcattagcatcttaaatctctatccaggggtgtgttgcttactgttataatgaacaaagggtcggtctgaggacaggtgtaatcaaaatgcatgtgctccctgcaggggaaattccttactgtagatagctgtgtttgaatgagctggactacagtgtgagtgctggggcttattgtgttaactgtattgtcgccatgtgaggacatgtttacttccttgactacctatcctgcctcagatcatctcactcaaattccctctgtgtaaaagagcagagatatactgttggagaatttggaatattaggtgatcatttacaaagttgtttgcataccttgaaaggaagccattaaataaatattacatttttggctcattaataattttatcatgtctagttaatcttcagattttaaaagagcttagcaaaacagactaaactgtatcagtgttcacaataaaaagccataagattgatactttttccttaagaacagaattagaattctcctgacagaattttttaaagcacattgagtgattttaataatcataaaatttagctgggcaaggagggaagctgcagggacagaaggtgactgacagatactgaaaagtggtatgacaggtattaatagattaaaggaggaagaattgttggagtactgtaggtagtgtgctagaaatacaaaaggtggtagttcgtaagctggatatttaaagggattgcagtctttgctgatgagactaagcatatgacgacaggaatgagtgtgagagagaacctcaagaaactgaaaggccagactctcagagggtgaatattgaagtcaccaagaattatgacagaagtgtgagtgcctgggtttgaatcctgatactatgtacttaccaggtatatgtccttgggcaagttatataaccttagtttcctcatcagttaaaatgaggataatgatagtatagttctctgaattatcaggagtaaacaatttaatacttatgaaactcttagtatgtggtatatggcaaatgacatataaatgtttataatattatcagaatcataataaccattattatttgtatgatccagtcctgtgtgagtctccgcttttcattcactagaaatttattaagcgactatttcatgccaggcattttgctaggtatcctgttaaaacttctgaattattttatttggctgttttaggcttcaggaatttcaagtggaacagaaataatatactgcagcctcaccaaaataaaagttattcttgaagtctttgccatgagttctccttgctgaattaaaatgctgtttagtaaggatacagacccagggggaaatggagcaaaccaaagcagtgattacttggatctctatactggacaggctcactgtagcaaaagagatgcttagaagcagactcagctgtaggacatgaaagagaatctaaccatatttttgaggcatggtggtgtccaaaatgtatggtgataggagatgggaagcagcgaagataaaaagttatccttgtggtgttccaacttgaaacagtgggttaatgtctggtagtcaggttaaacacagagagctaccattttggaggttggctgtcaagatatagacacttggatgttaggaaataagatagagatccagttactgagtaaaatcacttatatgattatcttctttaaaaaaaaaaaaaaaaaactatacccttaaagtctggggttcctaagagagctaacctaggctattcattattatttataaaaagtaccttaagtttgctttatcacctggccaataggcaatttcaccttctggctcaaaacacattttctccatctacacaaatgccaaccataatgttgcataagagtgagtgtgtttggtagactttagctaaaaatcagtgtaagtttgagcagacatggggaagaaaaacaatgtgatgtgaactttgttctctgtgtttaggcaagctacgacctatatctatgccagtggaatataattgggtgggggactatgaagatccaaataagatgaagagagatagtagaagaggtaagtgttctagaatttcagtgtaggctgggttgtttgaacaataagcaaatttaaatgttctgtaaatagattgttatggcttcagtggaaaacttattctatcattgactttattgtacaacaaaaccaagtaagaccaacatttgactatcttgacccattattaaacagatattgtctctgaatgccttctaaggggttccaggtacataagtatggtgttaaaagtaaatatctgattattatttgaaaggtaatatttggaacacaaggtcaggagtgtgaaactgcataaaataattaagttcagtgaataggaagagtttatcatcagtcctcatcggtctgcaatgcaacctcaccagttttgtatggaatcaacctcaaaatgagcattgaagcacatgggttaaaagctaatggaaactgggccagtgacttctaacaaaaaccatgtagaaatagaaaaaaaaaaaaccgtgcttttttttcctgttctgtttgctgctcagagttatcttcttacatgggggtgggctactcttgaaggatctaccaaaagtaagtttttatgttcacttatcctgctatagagatgagcaatagagagcaactgaaagtttccctactaaataggatttgatcaagtgtgggtatggtgggcccagtgggtcatgctgctactttgactttctgaagtagagagccgtaaggtcgtaggtggaaaataaaacaaatcaaaacaaaaaactattcatagaatgtaagttcactaagcttccttcatgatatgtttgacccgttttcttgttatttctagccagtatacagaatttattttattactgcacagatccgcagaccatatggacaagcaagcatgaatatctgattcattagtcttcttaatacttgttttatggagtgagcatttctgaaaatgttgataaatacaggaacattgacagattcctttatatctgtgtattcattccattttccaatcttcaatttctaatctcatttgttctatagaataaatcaagaaaagtataaaagagaaatgcttatcacatgctatctcagagtcactgttttgggacttcatattttagagacttttgttgatggggaggggaaccatgtgaagtactaagagctgactaccaatttaagcatagaattcctgaactaaatttcctgactattggttcttaatgtgggccttaacttctccaagcatgctaccttgcatgccacgggccggtgtttgttattgggctttggcaaaatccccatgagggtgattgttacaaattttataagccacacacctagaatttctgattcaagttccagaggtgattctaatgtagttggtccaaagctaaaacttggagaaataatctatcgactgtctattttttattgtcttatcataccaaataattaagatatactgtatttcactacatattttataagttaaatcaagttaaagttctgaaatgaaatatattagattggggcaaaagtaattgcggttcttgcaattaaaagtaatgggaaaaactgcaattacttttgcgccaacctaatagcacaattgagaaagaatggtaaatttggggtatttgtgtatttatattggtgtatttatctctttttatatagaaaactctctacttcggtatatgagcaatgaaaagattgctcaagaagaatacatgtttcagagaaacagcaaaaaggacacagggaagaagtcaaaaaagaagggtgataagagtaatagcccaactcactattcattgctacctagtttacaaatggatgcactgagacaagacatcatgggcactcctgtgccagagaccacactataccatgtaagtaaaatttcaaagactcttcaatacagcttttattggaagactggcaagtgactcttttgggtaaagtctaggttatttttatccttttactagattttcacaaaagagcctaactttaaagtttatgcccttaaaaaatgatgggtaattgatttttttcttaagtttatgtgttcaatgagttcatagttgtagcaagttggattttaatgggataacttaatatgcacaaaattgatggagaacaataataaatagctgattaatcatcagtgtgatactatgcaatgcacagatagctataaaattcaacattaaagatataattttaatatagtcatgattccatttaaaaatgaccatctattattttctagacatggagagtagggctagaggtaaaatgggaagacgtgagacaccattttatggggagaaagacatgctgagagtcccagtataacttaactgttgtgatgggtgggtgcagaaagtataagaggaacataggagaaatagagccttagtctttaggggaagtgagaaaaggcttcagagtggggagcatttgaatggagaataaaatatgagaagcagtattttagtgcgaaggcatatgcaggtgcgccacaaatgtgtgagaatgtggcatgttccaaggattttgtgtggcttatgattgctggtttattaacaattggaggaaatggcatgaggaaaggacagtagatgggcctggagtcataggtaaaggttagatgaggaactgtatgataaagtacttagtttctttcctgcagtaataaagagctattgaataattttgaactgggaacttgcgtgatcaaatcggcctattggatctctctagtgcagagcgtcatttgagagatcagaagcagggctattaagtccaggccatatggatgatgagaaactaggataatggccgtgtggaagctgagaatcatgttagcaagaacatttaatccacaaaattatgcatgttaaaccattttggttaaaaggagtttgttgtgtcactggaactatagcttcttattaggagcccttgaaaaacatggactgcaagtttttaagtaatttgaatgattgtgcttaatgcttaaaatatcaaaaaaattttaatctgcccctgctgtagaaggtatagcatctaggcattcaaaatgtgaaagatttaataacttacaattgagttgtttctctgagcaaatctcttaaatcatctacttattctatagctcttccataaaactagagtgtagaaaaatgtttttttttttggactatagtgttattagcactcctaggtgcctcattctttaccctcccttctccccagttacatactctcagaagtctctaagacactagtgcctgtatcagaatctgctccgttaaatgactgatcgattgaattattattttttccacagacattcagagtcagcctgaaatcagtactcttagtcgtttgaaaggggaccacttttgttattaccactattcagaagagctgtatgagcactgagcttcctctagaatctggtgttccagtcataagtaataccctgaacaaaagtttgaagatgagggacagatggcctattcgagagggtagttggtagtgagagatgaacctagagaaggaagaagagaccatcactttgactcagagtgtacaaattattaaaagtttggatttatcctgagagtagtgagtcattgaaggcacatttaaatactcagcctgctccattctgtcatgcatatcctgacagatgttatactgtgtgcggaaggaaagtagttaagtcttgtgaattatgaagtattaaattagggaagacagtaaaaggtgagccaaattggtaatcaggaatattgcgaatatttttgaggagtataaattgttaccacctttctgaaggacattgtttagttatgtatatcaagaatctgatctactaacttcacttctagaaatttattctaagaaagaaatcagagtccacttttgcctcctgtttttattatatgtcttgaatctgtaacatggtatttcccagatagttgacatctatctcaactaatttttgacagaggaccagcacagagtaaggaatattgttaactttgggggagatcttcccctataatgctgatacaccaattccagagtagaaggctgggtatttcctaactctgttctcaggtttagaagaagcaaaataatcgctaacccccaagtgcgtattggatatctataaccaatgttgtaaaagagagaactctaattggtggggtttttactaggctcttgagttcccttgaggatctcaccttgcccttatttagtgctttcacagttagcaaggaagtttccacatttgatatgtcttttgaacttcacagcaaccctatttgcaaataacaaaactcaaactcagaaatgatttacaaaagctgttttgcaaaaaaaaatacaagtactgttgtcaggactagaaccaaatcacctactccaggggtctttccgcactctatcctgttgctttgtgcatggtacacattccatatacagaggaatttgtgctttaatgaataaatgagtgcatttgaaaggcttgacttgaaaaaacatgtggccttgtatgatgatgttaataatgttttcagtgcctggattgatttcttttttgcttcatgttactatttgttaagttaggggaaacatactgagctgccgctgttataaaacacaaatagttatttagcttgatctattgctgggacaacagaatattatagttaacaatgcttggaccttggagacaaaacaacatacgcttaaataatagctttttatatttcacaggaatttctgttttatttttacctgtttatacatgcttatttaaaaatgaaaggcttttttcttatgttaaattttcctgaaaacacaatgtcagtatcaatctgtaatctaatcgctttcatgatgaaccactaatcttcatttttgccaattactcctttggataacatggccatgtttaatggaataggacttaagtggaagaggactatgaagattgagtattgcatttcataggcttctatctctgccgtaatactagctctatgtaatctaaagattttaagttaaaagttagagaaaatttagtatgaatttaatagcaagataatatcatcattaaatccccttaaacggcaaagtaaaggggtgtgtgcatgcatgcatatagtgttccttataagcacacctagagtatagtcttcactgttctgttgtggaaaacgtcccaataaaaatacacaaagcaagacaaatattgtttggcttcagggttcaactcattatcctataatgaagacttagaagtgtatgggattataaaatacatttttattaattccatatatctgatattctagttcatatatatttttcttaaacttatttaaaaggaaattattcactgtgctgtagctaccctagtcattgaccagctctttgccaccactttccttttcaacatgctattcccgctgctgagaatgcttttatctcttttttctcccaagaattcctgcctatctaaacctgaaatcacaaggacatcttccctgaccactaccctctgaactaaatcagttctcctattttctcttatcatccagtagtttttcttcaaaacctttgttgggatttttaattatatatttatgtgaacatctgcctagtgtctttctctcctgtacatggtaggacaggtatgcctatgttcatgatgataagcagggacaatttctccattttgttcagtactgtatttcagcacctagtacaaatgtagtaccttataagctctcaataaaaatgtcatgagtaagtgaattaatgagtgagtgagtaaatttgacaggaacttcagtggctttctcagtgtcttcaacctgcaaacatagccccctccatctcctaggtcaaccccacaggggcgaacaatgcaagaggattagctgccttacatcccctaccctacctccttcactccagctgaaaacttcagttccagctagttcttgcttgcttcctttccctgccatctcattacaaaggttccaatatgcccatcagccaagcatgttatgacatttttcaaaagagcataactttattttacctacttactgattctgtctgaaaatgtggaagctgttagctgccaaagccctcatctaacctgagagtacatgaagacaaggcagacagaagtttttgtgtggtgtgtgtgtgtgtgtgtgtgtgtgtgtgtgtgtgtgtgtgtgtgtaaaattcagatgtggtaagaaaagtctttaaagaataactgaattattctgaatctcatctttaaatcttgtaggacttatttttccccaatatgatgtgcatatgacaacttgctctcacattaaagctgctgaactaaattcatatacaaaataattacttaggccgagcacggtggctcatgcctgtaatcccagcactttgggaggccaaggcgggtggattgcctcagctcaggagtttgagaccaacctggacaacatgtcaaaaccccatctctacaaaaaatacaaaaattagctggatgtggtagcatgcacctatagtcccagctacttgcggggctaaggcaggagaatcactggaccctggaaggtctaggctacagtgagccatgtttgcaccactgcaccccagcctgggtgacagagtgagacactgtctccaaaaataatagtgataataataatagtcatttattttaagtctacatgctgagatgccagaacaagtaaaattggattatagattcaagcagtatgtaggtatactttcataaactgaatactgatgtaattttggatgattaaaaacagacttttagtaggtgttcaaaaatctggataattcctttcatgacattcaaacatttaggtggcctgtctttgtttttttaggatataactgcaaacattcaattgttttatgtctcataagtactttcagccactctggccaatttgtgaggttttgtggctttttttgatggagggaagaggggtagaactgttaaaaaacatttttatttttttttaatttagcaagtaaataaacattatgaaaatgctattctgattactttacaaatactatcttatttaaatctcataatgctgtgaggaagctcagttgctggtgttatcctcattttacagactagaaagctgaggcacatggattaattaggtagttatgtggtagagctaggatttgaacatttgcactctggctcttagcatactatattgcccctcaaaaaatagcataatttaacagaaacctaacaacagttgtatagtggcaaccacgtgtaaagcccagtctaagtgcagtggtatatacaaagactaatacaggcatatctcagagataatgcatgttcagttccagacaaccacaataaagtgaatattacaataaagcaagtcacacaagattttttaggttccctgtgcatataatagttatgtttatactatactgtagtctgctaagtgcacaatagcattatgtctaaaaaacaatgtacataacttaattaggaaatattgctaaaatatgctaatgattatgtgagccttcagcaagttattattattattattattatttttgctggtggagggttttacctcaatgttgatgtctgctgactaatcagggtggtggtagctgaaagttggggtggttatgacaatatcttaaaacaaaatgacaaagtttgctctatcaatttactcttcctttcacaaaatatttattagcagcatgagatgctgttcaacagcattatatccacagtagaacttcattcaaaattggggtcaggctctacttccaattctagttctcttgttatttccacaacatttgcagtgacttcctccactaaagtttagaacccctcaaagtcatccaggagggttggattcaatttcttctaaattcttgttaatcttgatattttgacctcctcctgtgaatcacaaatgttcttaatggcatctagaatagtgaattctttcgacaaggttttcaatttactttgcccagatccatcagaggaatcactatctatggcagctatagccttacaaaatgtatttcttaaataataagacttgaaatttgaaattactccttgatccatgggcagctgaatggctgatatattagcaaacatgaaaacaacattaaccttgtacatctccaacagagctcttggttgaccaggtacattgtcaatgagcagtaattttgaaaggaatcttttctttctgagcagtaggtcccaatgatgggcttaaaatattcagaaaaccatgctataaatagatgtgctgttttccaggctttgttgtttcatttataaagtacaggcagagttaatttagcatcgttctcaagggccctaggattttcagaatggtaaatgagcattggcttcaagttaaagtcatcagctccatcagcccctaacaagagagtcagcctgttttatggtttgaagctaggcattgacttctctcaagctatgaaagtcctagatggcatcttcttccactgcaaggcatttcatctgtattgaaaattctattgtttagtgtagccaccttcatcaatgatcttagctagatcttccggataacttgctgcagcttctccatcagcacttgttacttcaccttgcactttttttgttatggagatgccttctttccttaaacctcataaaccagcctctgctagcttccagcttttcttctgtagcttccttacctctctgatccttcatagaattgaagagagttagggccttgctctggattaggctttggtttaagggaatgttatggctggtttgatcttctatccagaccactcaaactttctccctatcagcaataaggctgtttcgttttcctatcatttttatattggaggccttgctttcagtatatcttggcttttgacatgccttcctcactaagcttaatcatttctagctttgatttaaagtgagagacgtgtgactcttcctttcacttgaacacttagaggccatcgtagggttaattaattggcctaattttaatactgttgtttctcagggaatagagaagcctgaggagaggaaaagagatcggagaacagcccattgggagaacagtaaaaacagacacaacatttattaagtctgttgtcttacatggcttctttctttaatcctcataaaccaacctctgctagcttccaactttgcttctgcagcttccttacctctctcagccttcatagaattgaagagagttagggccttgccctggattaggctttggtgtaagggaatgttgtggctggttttgatcttctatccagaccacttaaactttcttctgttttcttctgtgtcagcctgtcttttgaagctttgaagccaggcattgacttctcctctctagctatgaaagtcctagatggcatcatcttccactataaggctgtttcatctatattgcaaatgtgttatttagtgtactgttgttcatggcaccccaaaataattacagtagtaacatcaatgatcactgatcacagatcaccataacagatataataataaagaaaaagttttaaatattgtgagaattaccaaaatatgatacagagacacgaaatgagcacatgctatcggaaaaatggtaccaatagactcattcagcacaagattgccagaaccttccatttgtaaaaattgcaatcttcaaagaataaattgaagcacagtaacaggaggtatccctataatatttccactgctaatattactaatagctagcatttactgattacttactaagctccaatgctaagcacttaaatacagtatctcttggaatcttcaaaatgatcctatgaggttgatatcattatttctattctgcagaactgaaaggaactggaacacagaatttaccttaaagagctagaaaatagcagagtttagaaatgagtccaagcatcctgactccaaaattcacacctttgtgtgactaaagccatatctgctcataaggattttatcatctattagggaagacagagctattattatcacaataatggaaaaactgtgatattactaacatataaacattcataattaaatttacctgcagttataaaggttggtttgtctaacggctgcctgacttagctgcattctttcaggataaaagtaattcaaagaagagatcagttattttagtggcaaagaagccacctctaagccgtcacttgtttataacaaccaatttctctccgttttgactttattcacccagaagacagctgtattacagaatgacatgatgtttctcccaatcaaggtacatttagacatgttagagtacaacagtacactaaatattatcatattcatttgtatattctctgattcctatggatgactttattatttctaaaatgtttcatagtagcatttgcaaacccctacatgggaacagtctgtactatgaaaagtatttcccagtgggctgcttccctacagcagtgattcccaaagtatgggccatccttggcaaagggctctgatgactgaggtctgacccagaagtgacagtactttctttgattcttatgggcaaataacacatcacaaacttccattttcacttgtgactagatattgcttactagtaacctactaaatgagtttaaaaggttacaaattgaataatcataaaataatacattcatagaatttattgaatattctaatttagtattttttcagtatgcctgtgttttagttcattcttatactgctataaggacatactcaagactgggtaatttataaaggaaagaggtttaattgactcacagttccacaggactggggaggcctcaggaaacttacaatcacggcagaagaggaagcaaacacatccttcttcacatggcgacagcaaggaaaaccgcagagcaaagcgggagaggggaagccccttataaagccatcagctctcatgataaatcacaatcatgagaacagcatggaggtaactgctgccatgattcaattacctcccaccgggtccctcccataatacatggggattgtgggaactataattcaagatgagatttgggtgggaacacagccaaaccatatcattacgcccttagcccctcccaaatttcatgtcctcacatttcaaaagagaacttcccaacagtcccccaaagtcttaactcattccagcattaactcaaaagtccaagtccaaagtcttacctgagacaaggcaagtcccttctgcctaagaccctgtagaatcaaaagcaagttagttactgcctagataaaatgggggcacaggcattaggtaaatacaaccattccaaatgggagaaattggccaaaacaaaggggcaacaggccacatgcaagtctgaaatccagcagggcagtcaaatcttaaagctccagaatgatctcctttgactccatgtctcacatttaggtcacactgttgcaagcggtggggtcccacagccttgggcaactctgcccctgtggctttgcagggtacagcccccctcctaactgctttcatgaactggcattgagtgcctgcagcttttccaggagcacagtgcaagctgttggtagatctaccattctggggtctgtaggatggtggccctcttctcatagctctactaggcagtgccccagtggagactttgtgtggggactctgaacccacatttcccttctgcactgccctagcagaggttctcaatgagggctccacccctgcagcaaacttctgcctagacacccaggcatttccatacatcctctgaaatatgggcagaggttcccaagcctcaattcttgacttctgtgcacatgcaggctcaacaccacatgggagctaccaaggcttggggcttgcaccctctgaagccatggcccaacctataccttggccccttttagccatgactggagtggctgggatgcagggcaccaagtccctaggctgcacacagcagagggatcctggacctggcccacaaaaccattttttcctcctaagcctcccagcttgtgacatgaggggctgccattaaggtctctgacatcacctggagacattttccccattgttttggtgattaacattcggctccttgttactcatgcaaatttctgcagcaggcttgaatttctccccagaaaatgggtttttcttttctactgcattgtcaggctgtaacttttccaaatttttatggtctgcttcctcttgaacactttgctctgagaaatttttttcaccagataccctaaatcatctctctcaagttcaaagctccacagatctctagggcaggggaaaaatgccaccagtctctttgctaaagcacagcaagagtcacctttgctccagttccccacaagtttctcatcttcatcggagaccacctcagcctggacttcattgtacatatcactatcagcattttggtcaaagccattcaacaagtgtctaagaagttccaaactttcccacattttcctgtcttcttccgagtcttctaaactgttccaacctctgcctgttacccagttccaaagtcagttctgcatttttgggtatccttatagcagcaccccactctactggtaccaatttactgtattagttcattctcacactgctaataaagacatacccaggactcggtaattataaaggaaagagatttaattgactcacagttccacagggctagggaggcctcaggaaacttacaagcatggcagaaggggaagcaaatatgtctttcttcacatggtgacagccaagagtgaaggggaggggaaagccccttagaaaaccatcaaatcttatgagaactcactatcacaagaacatcatggaggtaactgcccccatgcttcaattacctcccactgggtccctcccaccgtatgtgggaattatgggaactacaactcaagatgagatttgggtgggggcacagccaaaccatatcagcctggtacctatgcagccctgacagtgcaatcatgttcatatcgcacaagcacaagtgtagatgatccagttttctgtggttttcaggaggaatgctctattgatacatcattgggattttttaaaaagtaacctatagttttcagtggctgtttattttcattataagttatcattagacttcatcactatcaattttagtttgttttaggttgcttgctttaccctctaatatgtagtgattcatatttacctataatttttcaagaatgatactgtgaatcatccatacccaacagtacttacagagtaatcgtctattggtatacctagttattttttccattgaaaagtagagataaagagatagacccaagggatctgttggcctgtcttagggaaccacagtcaaaaactgtggaaacccactacctagatacagatatatggttaaaagaagaagaaaacaatattggctttacttggttataaatataaaacagttttggtgaatgctagtccacaaaaaattagttcacttgtacttcctcacttatttatataatttgttctttttgctttcatatttaggaaggtttggtttttttattaaaaaaaaaatcaactatcggtactcctcctatccccccatattctcattcaccgcaaactggtgtacttataatggaactggccagactagaggatttaataatagaattactctttgaagatttaaagattcacaaatacaaactttcagtcccagataagatggagtacacacattttattttatttttcctgctactcacaaccaaaaattacctggagaaaatacattaactcatctaccagaagactctgaaaggtgcaaaaaaataaggcagacaggctagagacctccagacccaaggaagtgctgtgagttcccaggcttttttacttgcctcctgtattacctggcctgggtgttataaaagcctgcaacctgaaaacatcaataggcaccgacaaaatacagtctttagccaacggactctctttagccaacatgacagaaatattttaacaacacctgcctcttctcaaggcagaaaccgtgaaaaaagtcatgcttctcttccttcaccacaacaggcataaagaggttcaattcactaagaagacatgacaatcttaaacatgtatgcaccaaataacagagattcaaacagtagaagcaaaatctcccagaactggaaggacagattgaaagatttacaattaaggttggggtcttcaacatccatctctcaataattcatagacccactaaacaaaacaccagcaagggtacagaagtactgaatgactgtccaccagcagtttctaactgacacccaacaacagcagaatacacattattttcaaatgtgcatgagatactcatcagaatagaagttatcttcagtcataaaacaaaccttagctttaaaagaacttgaaataatacaaaatatgttctctgattataatgaaatcaaactagacatcagtaacaaaaagataacaagtaaatctccagccacttggaaattaaagaacatacttctaaataatccataggttaaaaggaagtataaaggaaaatgaagctgagtgaaaataaaaagcatatgcttagaggaaatttatagccctaaatgcttacatgagaaaagaagaaagatggcaataatctcagcccctacctcaagaaattagaaaaagaacaaaacaaaaagcagaaggaagatttaataaagataatggaattcaatgaagttgaaaacagaaacaataggtaaaatcaaaccaaaagctatgggattttttaatttaaaaaattgacgaacatctagcaagactgataaagagaaaaaggagagaagactcaaatgaccaatatcaagaataaaataggcgatatcactacaaccctcatagacattaaaagaatactaaagaaatacaactctgtgcctgtaagtttatcagttcagatgaaatggaccaattcctcaaaacatacaaactgccaaaactcacccaaaatgaaatatatctgaatagttacataactattaaagaaatttaattaactattaaaatttccaaaatatcaatacagaaatactttaaaacaaaagaagcaaaaccacagtactaatatttttgtattgattgagtgtgggaataaggaattttgctttcattgttatgttctgcgctgcttttaaagtgttggaagcctataagagatttgatgtacaagacttgtaacttaatggaattcctaagatactgattaaattcatcagttttattaattttgaaaatattgtttaaatgtttagaaatttttatttcctcaatttttaagttttaaaatttgaaaactaaacaaacaaaaagattcacaaatatgccctcactcttgagaaagatttttgctccctgtataaaacagattactgataaactgaagccagccctttcagcttcacatttgaacaaatgtgggtctcagtctgctacttcctgggtagaaaatgactgccaggaagcaaaacacaaaatttggctcaattagtgatgcaccatgtaaaacatgatgcagaagaattgaattataaatttattaaatttaagtcttatttttaattcctttttgcctttagggaaaaaaaatacacaaattctaataacaggcccttggcttggttggtaagttcagtaattaaaaactatttggggacatacctgcctttagttgctttgatcagagagcgtaaagaagccccattcccttttatgttgtagacgtttgtctcctagctttatagcctcagaaaatgtcctcaaattttgtaggcaattggctttttttttgctcccataatcaccctactcgtattaccttgccaccataactcatttaatcagacatctcaagtttaataaaactgtaggtagaattatcttacccctagaattctttaaagcctattctgattgaaggtcataacctgtaccaaattattttcttcacttaactcccacaatatattaatattactcccttgatggtttcagcactctcagcctccacaaaactatgggtataatgatttgctgtatgtactaaaattatccaaagtttcctcttaataaatgatattaaggtacaataatttattactgttagattctagttttttaaagataaattttctaagaactatgttaaattgtttgcagccattatggatttttcactagttttgactctgacagcaattggcaatggaccaaagtgcataagctcaacctagagtctcagttctaaatgatactgctaaatctgtctcttaacatttctacaaataccagggtaatttaggaacaggatcctaatagacttcaatccaaaacaacttggaatgctgagaaatagatcaatgtttcaaacccatgttctttatatgtgactgattttaggtaaattagtgtaaactttcctgccatagtaaacaggagaataagttgtcttcccatggtttcttttattttcataaatctagagtggtcccaagacataatggttcttgtgtctgatagtctccagataagagttcagcattaagaagagaattgccttttttaaaattcagctataggtcagctatatatttaaatatatatagctatataggtcagctatatacttaaatcagctataaaaagctaggcacatttctgaacctcagtttctcataggtaaaaagaggataagactacttacctgttttttttttttttttcagaattaaatcacacgttgtatataaaattatttccactgtgctgagcacatactagctattcttaactccatatagaaagaaaattagttactctgcatgtaagggaatttatcttctgatgagcaaatcaggaagccttctaggactaaaacagaatgcacttcttttgggcattaatgagtatatccattgaagtacaaccagggaactagaatctctaagtggcatggaataaaggactagatcttattcagttgaggagctggcaaagatgcctcagcagagccagtggttgggaagaaaatctagacatgaagtgaggaagaacaagacaaactagaacccatgagcacaaaccagagcatttcctccaacttcaacaagaagctggtacccttctccatggagattcacagattcatggtcccatactcaggtgctgaaggaggagatccgattggagctgaaggagttgtagacctggctgctgactcacaccagtaaggcaagccaacagaaaagtaaaacaatgtgtatcagctgcagcagtgactgacaccctgccctgaccttcggagcaaaagagctgctgctttacttgtattctccaaaactgacacaaatttacgtagtggccaaccctaaactagaaccatatagacaaaagaattctaaaacacatagttccttccagcttagctaaattgatgcaataggaaactaccaaactgaggtttccttctctgtggccattatcagtgtttactgtgtaaaacctgctttgaaaattctctactgggagtatgtatgaggttcagtggtaaaataaaaatcataaattatcataaatctagagtggattcaagagtgtagcctacctctatgagagtaccatctccacaacctacttctttaatttaccaaagcatatactgagaaatacatcttagccaaatgttgaatcttcttcacttagttgcattttaaaataatgtcctcaatttttatcatatggttattacaagaaacagccatatgaaatacacttcttcatttgctataaaatgttttttgatattgtattttctatttctttgtaccttccatcatatatatttttataattgggtaaaagctttggctctgtgtggtgacagtatatgtaaagatctgattcagtgtctggcactatgatagtgcacaaatagtatacccttcctccaacagtactaccaaaatgtcctcaccagtgggctgagaacaagcaaaatgtaatctaggtgcatttgaggtaaccagttctgaagaagtggcagcaaatatcaagccctccagaaatttaattttttatactgagattgcgtaagttgcctcctttcttttactcagttttctcatttacaagacaagtgtagcactgcagagaggactatgaaaaatgccatctaaattgacagcataatgatgatttgattcctgctgcaagcgcagaagttaaaatatctccccatcaagttcttttttcccttctgttagataaaaccaattttcctttttttagtcttaaaatcatgttttactatatagttcagtattaaaaggaacagtctgaattatatatctcaattattttataaaataaattgcatatagtgacttttgatactttttaaaattctatttttatacagtactctttgaaaaatatttctgttatgaaaaaagtctctaaatcaagaaaactctattaaaactaccagatgtagaaacatctgaagtagttgtgttggagagcttgtctattatataagagcaaaaatatcagaataagagtttaacagaaacgtagtattaatatgataaagatatttagataaaagctagcattcttggaacaaattatactgacacagactttcataatgagaaatatgtacattatatcagagaaatcaacctaaaaataaagttaaagtaatcagaaaaaaactttgatttcagattcttttacaaataaaaccattaagtccacaaccagaaaagtttttcagtaaatatgattcagtcacatcattgctgacagaatcatcaatcataccataattgtgacttcatttgagattcttgggtttcatgcatctctgttagaggtgattctttctatattatttattcctctatttcttttacacatagtttatttccttgtcattcattagcctgcaggtagcaaatctggtcctctccattttttctggttataaacatttctttgtcacaaaagacaggcaaatctactcttatttctctgacacctaaatttcaacggtttctgtcaaacagaagtgtcaggagtaggagctgccctagttctgcttttcacctgttagaacttgctgcctctgtctcaagtgcaaatctatgttaattgtacacatcaatcaggcaccccaaaatagctgtatctaatatggctggtgataagttatttccatacatggtggaattcaaacataaactaagtgcttttcaatgaataatctagcattcagtgttaagactgacactgattacaggtatacatataatatttcctaaaacatcaataattaggtctccattggtgatcattaactggttttccattcatttttaaattatgatcctggaaagttattgttctatgagacatactaagaacatgtggtccaaatccctgatttcgcagttgaggaaattgaggtcaagagtagtccagtagcttgatcaaagtcatagagctggaatatagactgaaatatgaactgaaagtcaggtctcctgattcctaccatggtgttgcttcattggtaatgtgtgttcctttcttgctgagaaatgagcattctaagtgtatcactccaactgatttgttgaaaatagactgaaggggccaagggtaagtgtggaagcggggagacaagataggatctggtcaattcaagtgagagatgagagtgacttaaccctgggtgttaaagtggaagtggtgaaaaggggttggactctggatatgttttgaaggtaactggacaggatgcgctgacagattgcatatgagaagccatgaatcatagcccatacctcagtgtcccacacataggtggtgagtaactattcaattcatgccttcaacagataattgtatgtcgcatcctgtgctaggagctgagtatagagtggtgacctaaacaaatggtttctgccttcatagaactaatatagtaggtaaaaaccattccttcagaaagtgagccaagtaattccaaagcattgcgtagtattgaggagtgttttgggtggaaaatggcataacacaatgaatcagctcaagagagtaaagaattagtcaaaaggcaggctggatccatgattttctcatcagtattgacacagggttttctaattgaactgagttctgttaataggcttgtactgaaatgtaattgcagtcccatctctgtctacttaggctgggccttataatattatcgtaccttaatttctgtctcaattgcaaaattaagatgttaccatgagccttcctttcatgcagatgttattataagcggttgcccagaaactcctgtaaatcttcttttataacctacagagcaatataacttgctaattaaaataaaattgagaaagcatgaaaattagagattgatgagatgttattggtttgaattatctccattgatataaaagtgtttttctcactgataatctttctgttttggagaatcctttctcttcacatagcaatgtacttgcatcacctgtcatgagatgttttcataaatggatgtcttagtgccagaagcactttttctctctctttaattgttactatgactacataatacttacttgggaggcagtaatgcatgtagtaggagtataggttttggggttgacagacctggctttgaattttgactctacccctacctgtgtgatcctgagcaacttatttatgcattctgggtctcagtttcctctttcttaaaatggggttaatgataaccactttacatatgtattataaggattaaaatggatcaattacatcacttataaacacttgtaagtgcttaatattgtgcctgacacataataagccctcagtaaatgattattattttgagctaaggatggcagttcttatttcccaagggtattgattcatgttagccttcctgaatattttccaagtaatcacttcccttcttcctacattaccactgtgtaggaacaggaggactcaccttatgggatcctgcatgagagtcaatcacatccttccttcagaatctgatacatatgacattctttttgatggaacattaactctgcccaacctaagtagttgtagtttgactgaccttctctagattcttaccaattactgtctttttgttcttatttgactgctaatttactggtttataaagcatgcttatttttgagtaagtgtggagccattttcagttatacatgtaccccgatcctaaaataaaagtttaaaaaaaatcaggtcgacctgactgacagaatccagagctacctcatcccactctaatgaaagacctacggtgtgtgcagtgccacatccttcaccctgattgactccaagtttttctttcatgcaccagaatgagcaaggccaccaacaacagcagacttaagttctatgctgttatttcttataaatggaaattttttgacttaatatttggttctattgtcatcctatcccatttccatatatttacttttttcttcctacatacaataattagaaagttaagagaaaacattttttgtaaagtatttaaaatctcaaagagttttacttgtttatttaaaaaaaaagtgtggaagcagctatcatctaaagtgtttcaaattgttaagcaccttcttttcttatgtataagaaagaagctattggtttgactagtcactgaagaaatcttggaactttgcagaaaattacagtaagaggaaattgctattactgcaacaagagagtactttgattgcaaatttttccttaagtgtgtcaatttgcaacttgagaagaatttaatagtagctgagctttcaaaatgtaacacagaaactgatttttttcacaattaaaataagtgcttctgataatttgaggataagaatgacccaaattaccctgcccccacacttctccatccaaaagagtggggaatgaagtttgaacagaacatctgtggacagaatgaaagacaaatggtcttttcaggcaaatgtctgaaaaagggatctttcatagccaaacagaatactgttgcatgcatcgccatggttaagaagatcaaaaatactttcataatagccttttattttagcacattctatttttatggaaagaattatgatttcaacacattcattcataactcatataattattagcataaatatcttttgacacagatttaatgtacttttgccaggcatattgtgaatttaaatttaaactgttaaatgcactaagacaatctcagtgcaagtagtgctgaaggagattggataaaaggaaattcttcttatctaccaaaaggaatggcctattaaagaacagaattttcaataatgtattatacatggattcatagacttcttcaagttacaacaatcagctaattaagattacaacctgtattctttgctgatggtttgttcaacatccattcacataaccagtatttattgagtgcctactgtgctaagtcttactctaggcagaggacaaagcaatacataaaacaggcagaattgcccttttttaatggagtttatatttggaggaagtccaggtgataaacaagaaatataaatacttaagataatgctaaatgctcagaggggaaacaaagctgggaaaaagaacagaaagtattgagggcaattgggataacaattttggacagggaagcttgggtagaatttactaaaaagaaagcctttgtgtaatgacttgaaggagttaagggagtgagccacaacaacatctgggcaaaaaacatttcagacagaagaaacagcaagggtgaaggtcttgggatgggactgtacttggcataatctaagaacagcaaaggtagctggaacaaaattagcaaggggagagcagtaggcaaaggtaacaggggaccagatcatgtagggccttcaagtcattgaaaggatataggcatttattcagagggacatgagaaaccattgatgagttttgcatataggaatggcatgatttaaatcatattttaaccagatcactctggctcttgtgctaaaaattagagggggctggtcttagtggctcacacctgtaatcccagcactatgggaggataaggcaagcagatcacttgagcccaggagttcgagaccagcctggggcaacatggtaaaaccccatctctactaaaaatacaaaaattagctgggcatggtgctgtgtacctgtagtcccagctactcagaaggccaaggtgggaggatcacttgagcccaggaggcagaggttgcagtgagccaagatcatgccactgcactccagcctgggtgacacaagaccttgtctcaagataaatatatataaatatatatatttatatattatataatatatgtataaattcataatatatatagtataaatatattagagagggtaagagcagaagcagggagaactgtcagggggtatttcagtaatccaggtgagagattgtggtggcttagaccagggtggtaataatagagctggtgagaaaaagtcatattataaatacattcattgtgaaaacaaagctggtaaaacttgctgatggattggctatggggtataagagaaggaaaagagttaaagttgactccaaggttttgtacctgagccactagggaggaaaaaaatgtaattactatttaataagatatagaagagtaggaaagaagcagatttggctgatgagtgatagatatcatgagctcagttttgtacatattaaatccactcagttaggcaggctttagctcagtgaagaagtcctggctagtggtatgaattcttaagttgctaaaggtcagaatttatggaacattcttagaaagttcgaagaactttcacccagatgctcactataataaacagaaagtgctagtgaaggcattagaaagattttaataaatgatgtttttggaaaaaatgaagatgggaatttttagagaattggacttcaaaaatgctaacaagagaaatccatttttggtgatcaataagcgttacaagcttgtgctttaaattcacatacatacacaccctcacactcaccctaccctaaacacatagcaataaaatgaaataaaagatatggtcatggtcaaaaatgaaatctaatctccaggcaccagaaggaacaaaaatgctcagtgataattgggacctaaagccacatatcttaggcaccgagtccagaaaaagatagagatgcctgagagtcttctctaatgagtatcagagaaccaatggacctcagctatgtcggaaatctaaaaattgactcacgaggtgtaaccaactgggaaggcaagcagagcttcctcattcatgagtaaggaggttaaagatgcagttactaagaaataaataaagatacagctacttgtataaaactgaattcctaggtgtctacaagtaacaaaaacagatactcagaaccatgggccatgcctctcccacttggatttcatggatggaactgcaacccattgccaccactaaaacgcctggttagtgtcccaaggaatggaggcagagacagcaagacgcttagttaagagggatgagtgcaaaaagaaacatccctccaggaagaaccttccacccaagctaaaattccaaagcgtctagagaaaattaatacttttttaaaaaaggcaataaactaaacaatgaggtgattttcttcactaaatgcaaattacaagaaggtcacaaaagcccttaaaatacatttttaagtaaaaacaggaaggttaaacagtggatattcaaaagagccactatcaactagatacactggaaatgtaaaatatatgaaataaacactctatcgataagataaactttagattagattagatacaatcagtgaaagaattaggaaattggaagacagtaaaatgaattcccctaaaaggcatcgcagaaatatgaaaggatacagaacatgaaggacacatggaagataaattgagaggtaccaacatatgtctagagttttaaaaaggggctagtaaagaagaccatttgaagagattttcagaattaaataacactttcaatacaacacaaaaattgccaaatagagtgaattagataaattgtaacctagacacataatagtgaaactgcagaatattagggataaagagaaaaatattttagaagctacagagaaactaaagacagattaaaacaagcaaatgacagtgtaactacagatggcttaagagaagaaaaatagatgcaaaaagaaaataaagtaatacattcaaattgctgaggcccaactcagaattctatacccagccaaactattattcaagaggaaaggattttcaaacattaaaactaggagagtttgccactcacagactgctgtgaaagaacttctaaagaatatacttacttgagcataaacttggaagaagggtaatctgaagctaatatgaaatatacatgaatgagatatattatgaatttttacctcatgagaaatacacttaccacgaatgcaaagattctaggcctctttcatttttcagttagttgttgtagcaccttatatgatcagctgtgttatgaattacggtcatatgtctgtttttaatgtcttgctcttattaaatttgcataatcttaaaactggaaaaaatgtaccaattaaatttctgtcactgacaatgaataattccatcagttctgctagaaaagatgatacaggatgataaatttgcacctcaggggtgcttactaacactgtagctgatgacataaggaaaaccctttctggagattatttatgtccattatttatgaataatgaacagtttctaatataagtttgtaagggatctttttgaatgtgaggctcttttggatgtccccaagaccacctacatgttcagtgatttgctagaagaactcataggactcaacatatagttgaactcacagctaggatttattaacagtgaaacagcaggaacctacagacagatcagtaaggaaaaaagacacctgtggaatctagaaaaatctatctgcaggcttcctgtgctctctccctcccatgataggtcacacagagcatactctcctcccagcagctaaaattcaatcacatgtgtgcagtgtttctgtccagggaagcccgttagagattcagtacccaaggatattgaattgggcatgtagacatcctctgcctagcaactaccaaaattccagacttccagaaggcaagtgaataatcagtgccccatgtgggcaaaataatcttatcatttagggaagcttcttatcagtatagggaactgtttaccagccaagttcctagatgccaaccgagggcaaatactgcaagtaggcctttctaagatggcaacctcaggcctgctacagtaactcttttctgcacagagacctaactgtatagttttaatagattttcccattacttccaaaagcatataatacaattaactttttcattttagaaaatgtcaagtcaattggaaaaataataaaatctctcttaagagaactttattttaatatttataatatctttaaaagacatctaaggctttgcttctttgaatgatggataaatctgtatttaatgtcttggagttttcaggtttccagtgcactgattatactctgcagtcatgatctttatggaaatatatttataggaaaagaaaagataatcttgttaaaaagaaaacctggagagtgtaaaatatgtttcatgtagatttttagagtagacattcaggttctacagaatagcatgcaaaaagcatagaaggtacattatataacccagttctttcaagctgtctgtaatctatgtagctttctaaaaacaaaccacctccatctttgtcatttttcaaaataatgagctgtaaaactataatgattacttgcagaaatacaaagggaaaaaaaaccccaatcagtaattttaccatgaaacaatgtagggaaaataactatctgtaaatgagctatacttaagcacactagcctgagttattatttgagttattattttgaagcaaagtgcattcaagaaaatcaacacagcataatgggttttatcttttatgctttctctcaaaatttgtgaatttctataaccatgcatgctgcaaagtttgatatgtgtgtgtgtatgtgtgtacacacacacacatataccacatacatacatatttataatgctttaacacttaggtgattatttctggaaagctttgtatgtcagcaaattatctgacccttatctttaggactgatacacatccgtagtactatgttcattagacttatataaatcatatacagaacaaaaattattatataagtagaatattatttaatgagcaatgatactaaataataaagtatcacaaaacatgaatttattgtgaaaaaagaccagcaaattttatataagcaaaatccagttgccccttatagatatatctttgtaaagaaaaagaagaatctgtaacctgattttcattttgaaggaatatctgtgaattaaaagcacacatgctatctctgttcccttttagctggctgatcatgtgaatgtaatgaatcttattataccagtgaacaatatggcttagtagactaactggagccagtgatgtgtagtcattaattgaaagttagaccaatcaatatagttgtgggtttttctctagacatatcaagctcttcaggtacttagcatggagtgaacagacaggtaggtttaactgggatggatgtttagcttggcaagtatgatgcagcgagcatggtcaagggaacgattataatggtatcccatggaaactaagaggaaagaaagaaatacaggcacaagagggtagttaggtcaatgaactggatgcctcaatgaagtttttttttaagtgatgacatgaaggtattagagactatgtaaaccatatgaattagatacagtggctggtgtgtgctttagatatcaaacatatgattatgggggtaggtagctgaggagtggggaagtaaatgttattagaactgaggaaccagggtgctgacatcatctacatgaagattagtcaccaataatagtgacagaagtaggcatgagaaaaaaatattgttccaagtgctgaaatatgtagggactaaggaagtaggagaacagtaggtgatggtggcttatgtaatagaatgaacttcatgtgaacaaaggatagtcatattttcctgcttacttcattagattttgtgagactcaaatgagatactgtctggcaaaccacaatatacccgtgaaaaggtacaaagtagtgtgtatgtgtaaaagcctttagttttaccaaatgctttgtgccctgatttctctgcctacaaaatacgggtaaatataatatcctttcctgcttcacaggagattagaaagttaagtgacatgatgtatatgaatttgttttgaggctttgtggggaaaaagttcttcccctaacagtgtttagagtcatcatttagctcttgagagttctgtgtagcgtgctggtgctctggatcacaccctgagtatcagataacattctttttatctttgatttcagacatttcagcagtcctcactgcagcacaaatcaaagaagaaaaacaaaggtaagaaaaggaaatgaaacctttacctgcttattttgctctttgataatccccaacacacttcatccatgccctctttcttgcctgagcccagtgtggtttagaagagcacaacccccttgtgcgaaagctgccagcttcttcttcagtgcaattataatacaaggtaccttttacaacaaatgatctcaataagttttgagagtggtgttacatatttctgattaagatgtgtgtcacttatgtgagggaaaatattaaagatttttatatttttctagtctaatacaatataaaaatttttaagattttcaagaactcatacttctttttggtatctatagattaatcctctactttcatacctttgacaaaattgaaagagcatttccaccctttaggtcctatagcaggcaagagcaaaagacgaatttcttgcaaagatcttggccgtggtgactgtgagggctggctttggaaaaagaaagatgcgaagagttacttttcacagaaatggaaaaaatattggtttgtcctaaaggatgcatccctttattggtatattaatgaggaggtaagataaagcaccttttgttttctcatccattctctatctttaatcaaaagaatcattttgagacttatattttaaaatcgtataatcaccttaaggccaattcagtagacttctgctaggtatttttcaatccaccctcttaaaatgattgcatgttggggttctagaaagatagctgtctcaattatgctaatgtagcaacatatctgaaacacagataaagtgtagtaaaattctgtatatctaaataaaaatgcgaagctaatccaagcagtagcttaactaaaaggattatatgtggaaatttgacattaatttttaaatgtcttgcttttgttcaaaattttacacttttttctggttttttttttctttttagaagtggggaaggggaagccctttactaatttaagtaaactaataccacctgaatttatttccatttttctttaaaaatgatctagtagactagttttgaaaatctgcaagtattcatttcacttggcccagtgggggggtatatatataatacatttaaattattcttatgattttctggggtgttttaatataacagatttatatccagaggagtcatatcaaaacttattacgtatcttgacagatatgccaaaaacatttgttgatattccctttattctgcatttgcttttattcctttgctatagccatctactagttcactttattagttttttaaaacaatgatttctgctatttccttattttataaaaaatgtacatggcttaatgtagtgtgctgggtgaatagtccaatactattatgttaagacattcatcaatttgcatttgaatattgttgaaatataatttaacaacattattatgcctacgattacaaaacataatatctagataattttatgttccctagacaggttataatgtagtgttatgttgtgtttaagagtagactcagaaatcataccacctgagttactgtgccatagtttcttcatctgcaaaatgagagtaataataatgcttatcactggactatcatatggatgaaatgaatcaatgcctggcacatactgagtgttcaataaacatgtggtaggctgggcccagtggttcacacctgtaatgacagcactttgggaggttgaggcaggaggatcacttgagctcaggagcttgaaaccagcctgggtaacatagtgagaccctgtctctacaaaaaattaaaaaattagccaagcgtggtggtgcacgtctgtagtcccagctacttgggaggctgaggcaggaggattgcttgagccagggaggttgaggctgcagtgagccatgattgcaccactgcactcagagcaagaccctgtctgaaaaaaatgtgtgctattagtaacatttttcaaagggacctctcattttatttgtaaaatcttgaattaatatttttctatttaatgtaaatgtctatatcacctatataaaaatatttggttgttttctgtacttttgacatttttgtggcaaatcacacaattacctaaaataccctctgcttcgctaagtgtgtcttattttaaatgtaggaaacaagccataattttacctacagtttcatttaatagatatatattaaatactttttatatgccaatcaaatattatcaagatatagtatctccatgtttctctttattgtaaggtcacttgcaggtttgtctgccacatactagattatatcctgtctttcaaagtttaagtgatgaaaaactgtggcccctttttgttgaactaagtttcattcagcaagttattgttactgttagccttgtgagagatgagtgaagaattctacagtatacattgcaagaaatacctttaatatgataatatttttaggagaaatgtaaaaatccctcatcacatcattatggggagataataactacctcaaaatattttaaattgttcaaaattttaaatatttacattatgaatgtcaagggtaaagtaacatagaaattaaagttgggaaaaggatttaaaaatactgtcttgtccttactccaagattggaagaaaaaatattcaaatactgaaaaagtttaatactactctttttcataacacatattcagtcactatcagtagcatcagatttttgttttgcgtggaagcttagcagtgaaagcagtcatacaaatatacaatctaaaagaatcgagaactctttttttcctctgtgatagtggatgggagtataatctcacttgaacttgatatataaggagctatggatatagcacagatcaaatgaaagttagagatagtaaaactcagaggagcttgatcatgagcagaacaagggatacaatgattaaagcatttagcaaaagatagttttagcttagttgggataactcgtatctaacataatattttggataattcttctgtcttgtttttccatccagcattagagagagcaggattttatggattttattccattttccaggtgaaaaatgacctttatatatatatagcacataccccaagccagatatttgaaagtcagattgacctatttcatttgtaaactcttgaatgcacagaataattgttataagacgctgatgagcttgcagagaagacaagaatacttatatactgttggtgagagtataaattagttcagccattgtggaaagcagtgtggcagtacctcaaagagctaaaagcagaactaccattccacccagcagtcccattacagggtatatacccagaggaatgtaaatctttctaccataaagacacatgcacgtgaatgttcattgcagcactattcgtgatagcaaagacatgaatcgacctaaatgcatatcactgacagattggataaagaaaatgtggtacatatacaccatggaatactacgcagccataaaaagaatgagattatgtcttttgcaggaacgtggatggagctggaggctattatcctttgcaaataaatgcaggaacagaaaaccaaataccacgtgttctcactcatatgtgagaactgaataatgagaactcatgcacacaaagaagggaacagacactggggcctacttgagtagggtggatgggaggagggagaggagcagaaagaataactattgggtaccaggattagtgcctgggtgatgaaataatctgtacaaaaaacccctgtgacacgcatttacctgtataacaaaccttcacgtgtacccctgaacctaaaataaaagttaaaaataattaaataaaagatcattgttgcataattagagaaaatcaaatttgataagagatttgttggaggaaaattgaatcagtgaacatccctatattttacatctgaacattaagaaaatagaaaattgtgaattacaaaagtggactacatttattttatatgttatagaagtgtatgtatgttctgaccagaaaattagttataaaacacattccactttgagaattaaagaattttccattctcattttaatatgaaaaagactttttaaaagttctatactttaatttgtagtattctaagtgttcaaaatatatcttcaatttatggagtacagcaggtaagcattgaattcttatctctaaaatgtcaaatttaaggaattaaaggaacggatttattagtacagatatctaagccatagttacagagtatcattaccttcacacctttgtatataataaactaaccaagagtcttggctcttcaggatgaaaaagcagaaggattcattagcctgcctgaatttaaaattgatagagccagtgaatgccgcaaaaaatagtaagttgattttatttgggaagagggaacgatagtttttttttttaatttccagcttttaaattataggttgctcatttaatgctttcacattgaggtaataagaaagcagttttgtgggcagaaaattgaactttttactgatttctgtcaccatgatagaagcattatatatgtgaactcgggttagatgttgaggtaattttgcccgtcagaattatttggttcaaacttatttcccaatttgtaataaatgtactttgtttccttttgcagtgcattcaaagcctgtcatcctaaaatcaaaagcttttattttgctgctgaacatcttgatgatatgaacaggtaaagtatttcagagtatgtagaaggtcagtgaggcctagaattctaaattttctacagtaattcttagagaataatgtcactgaagtttctaggtcaatcagtttaaaataaaatagacccagaatagctccatgcagccatatctaattttaaagaacatcatttaaaaagtcaaaataaactcgttaaatatttttgtcaagtttaccaagaccatatacagacccaaaaaaatctaccaccaaaaaaaggggattttttaagttcatttcaataatatgtcttaaaattgactcccagatgggggaaaaagagatgtctaccaaaaaatcggactttttgaagtactgagtatttttgacagaatattcatctcaataattcaggcctaagaaaaattagtatttctttctgtcacttttcatctttcacctgacaggaccacaaccaacaaatcagatagctcagtggttacttggtggctcagggaaaacttatatgtacattttttttcttttctcatcacctaccacattctgcttcatgttaatactttggcttttatgaattttgtgctttcttcctttctctttcctttcccctcttccttttctagaattatagaaattgagcttaagattcaaaattttcctcctttctataacttactagccagtacatattacaaatataacttgcctacagttagggagaggcagcatagcatcatggtcaggagcatggactttgcaaccagactctctaaatcccagctctaccacttaatagctgtacagccttggacaaagaacatgacctcttcattccaatatagtaatgtccaatctatacaagaggtggatggggctaataaccagcccaatctcagctctacactgattagctgtgagaccttgggcaagaaactgaacctctctatgctgaggtattagccctttaataaagtgaaaataagactgacccctatcagtaagacttttataaggagtaaataagcatacataaaggacttagaacagtgcctgctaaattataagtactatataaatgtttactattaatatatattccttttatatacgttgggttcttactccatctacctttctctaaaacaattgtacccaggcatttttaagcacaaaactgtatagctgcataaatttgcttgaacatactaaatgaacacttaatgtccttttataaataatcttgttctttgacatttgggaatacaaacatgttttttttttttcaaagcaaggatatgaatacaagtaaatggcaaagaaagatggtgttgagagcacttgattaaaacttttattactaataaaggaattgagcctttcgtatagtttccataatcttctcttaattcatataacttatcattcttgaaatttcacaccaagctataaaatttaaatagttttttctccttgttctcaaaatgaaaatatttattcacattcacatggagaaggagaggtgtgatactccattttatgttttaattattttataattccactgttctagtacttactatccattttaccatatgttaagctcaatacccttgggataaatacgaagaattttcatcatgaccacactgaaattaagtggcatacatgagcatatcgtatcttacaagatggatgcactagaatccagccaactccaagaattaatacaatgtaatcattcacaatacatgctaattgggatctttttaagcttagaagttgcctctttcaaagtgcattttatgaactataaaatccttcttggccctcattacccaccccaagttagcagtagcttcaaaaggatgctgatgtcactgctctttcctaatattttgtggctgtatctggttcgggatatcgcagaaactaaaccaaatttgtgtggttcattttgttggttttctaagcaataggtgaaagaaaaaaagtgaaacattaaaaaggccgtctccacattatacatttaaaagtgctgttttatgtaaagcctgccatggcccactacaactttaagaatttaattgtcccaaaatactgaattttattttaatttaattaaaatggatttttattgttttgctttgaattttgctttctaaaaaataaccctattcctaatgtctactttcaatgggaagatttttaattacttgttaatagaagggggaaagagtcagtgctacaaatattcacagaggattaatgatggggaggaacacccacctacagctttgtcaagtcacctgactgttacataacagcaagatgatctgggtgttggtttgttctatatgtaatcttttaaaagcatgtatctaagccttcaagagattatatatttataaaaattattataattatataatgtatgtgattatttcataattttttaatatcatacctacttcttatgaaaatacaccatgtttcagagaaatatatttttctgttcctcatttaaaaaaaacaaatgtaatgctggtggtgacaggacctagtaattggtgttaaaaagttatccttacatttaattttcttctgtaaaatcatacacatatatatatatatatatacacacacacacacacaacaaatatttatatatgtgtatacatacacatacacatagaatattaaaatatcaccttctattttgagaagcagtaagtttgattgtgaggtcatttgcaaaaacacttttaggcaccccactactgttcatctgtttcatcagaaataagcactgaaacattaaaaactgatttttttcttgtctgtgtaaaatctgtggggataaaataaaacatcatagtactcaggtattctgaagacttatttactgaatttgtttggcctatatattccttaccatgtcagtacacatgttcttgtaattgtgatgactcaccaattcctatttggtaattattatttatacatttctctcatggttctttctcttatttccctccaaacacattattctttgtcagttgtgaatatctcctttgaatgtttgctataggttcaatatcaccttacctgtattttcctattttaaagcattggtgatatggtaaggtactgactgaatttagacctgctattaaatatcttcctcataaatatattgaatagattctaaattcaatattgtatctctgaccatcttacctaaaatagccttccctcatccgcagcatctttggcattctaattttctaacttgcttgcttgtctgtttttaaatagcatttgctactatttcacatatgtttatttgcatccctgtttagtgtttatctccgtcactaagatatggaaatcatgaaggcaggcactttgttttatctctgtatcccaggtacctggcacatatagctgttaataaatgttgcttgaatcagttgatgcatatgtgtctgctttcataataacctaaaatattaaattataactgtaacaagtaaatcagtaagtatcttctagtttaatcctaaaggataagtttatccaagatagcaccaacaattgtgttgtatttagccccttgtggctctacacagtggcctgagtatatccacacactttctaaacaatttttcttcaattaacaaaatttttcttcttaagaatagtttaaactttcaattgtcttgtgaaacttagtaaatctagagttaattgaaggcagaaattacgtcttatttatttccgtatccctaaaacatagcttattgttcagcacatagcagacacttaataaatgctgttgaagtgaaaaattgagcaagcccctttttagtttcctaatttatttcttaaggacctctttgttctttacatttctgataagatgaaatttcagtgtttttttttgttttggtgtgtgtgtgtgtgtgtgtgtgtgtgtgtgtgtgtgtgtgtgtgagatggagtctcgctctgtcacccaggctggagtgcagtggcacgatgtcagctcactgcaacttccgcctcccaatttcaagcaattctcgtgcctcagcctcccgagtagctgggattacaggtgcctgccaccacacccggctaattttttgtatttagtagagactgggtttcaccgtgttggtgaggctggtttcgaactcctgaaatcaggtgatccgcccacatcggcctcccaaagtgctgggattataggcgtgagccaccatgcctagccttcagtgatattttttaaagtagtaaagataaggcactggattaaaattcaatgataaatttttctttagtggtattatcatcattttcaccaaaaagcaccaggccagtctttcccaagagtggtaagatatgccttgtggtacaaatttaacccctttttcactgcaaatcaacttagactaaattttaactttgaacttttactaatgattagagtcatttttaaaacattgtcatgaagtttacttcttgatttatagcttataattttctggatgtgtgtgtgtgtgtctatatatataccatgctactgaattcatttgataatctttattttattccagttctactccagtcttttcttcacttcccaaatgtacctgaggtgataattacattgtaggttttgctaaaataaagttaggttttaattgacctattcttacaattaaagcttaaatttccatagatgcgattttgtctattagagacaggaatttcctcacttttcaagattcaagatattctaagtatctgatgcacagttaacaccatttggcataaatgatgaaatatgagtcacttcaaagaatgtgatctttcacttgacagggaagataaatgtcttaggagaaaaagttctcaaacacaattttttcttaaaaatatatctagattagattattccacaacttaatgacattaaccatactagtgattctggacatattcaagctagcttgaaatgtaggtttttcttcaatttctgatttgggaaagtatatggattatggctcaggattgaccaaagggaaatttgcatgttgtttaaagacttgtgattagataatctgatagtgtaaatagttgaaataatgaacataaggagagccctggtgggacaaaagaaagacagtaaaactgtgctttgctttaggcagtccctacattggcaatagcagcactacagaaagagcaaagaactgagatttatttttaacttacaattgctcatgaaaatacatgttcaagatctaaacagatgttaaaattgtataagttcattgtgtctttggaaaaccccatacccttgtatttagagacaagtgtccgaagtactcccaagatgtgtttcctgttagattgttaaataagcttaatcaaaactatgatttcataataaaactattattttgacaggcaaggtccataacttttttccctcatcagaataaattgaacctgatactgtttaaatatctctaaaggagcatttgctctgaagaaacagaacagcaggaatatttggagtacttctacatttggaacaatagaattaatatggctttggtcatctccaaaccctttatgttacagatattaacagctttgcccaagacttttctattgaagtagcatctttggtatgggagcaatttgtactatagcaaattgtatctcattaaagattctatgtatcaatagtagcaaagaacacatcttatatgtaggattattccgtatattcttagacattttaaaataaatgtttctaggaagtaaaatataagaaattaggttacaatgttattgattttaatatttgttttctcaggtggcttaacagaattaatatgctgactgcaggatatgcagaaagagagaggattaagcaggaacaaggtaaaggaatacttttttaaaataattatgttatactttttttcctgcagttatcctatacagaaattcattgctatcacttgagagaaaatacatgtcaatttttggttatttctcttctaggcacttaagtgaggtttaacaacttatatagatagggactgaacgctcaaatttttggagcagctagtgtggagttctctcctatttgttaccccctcctcccatctctttcctatgaagaaacaaaatcttaaaaatggaaaaagtctataataggtcttatgattgaaccaagtccagatccttagcagtgagcaatttttactatttagcagttttatagacatttaagtggccttttatgcaaagaaatgagatgatcttttctttcttaaattttctcatttggtaatgttcttcagctctgttactgtgtaactctgtgatcttatggaatttgccttggtattgacctcagatttatgaaacacagtgttatggtgcagaattgaaatcttaagaacaaaagctgtggtcatcgttcttaggtggcttcacatttcccaaagggtgtttgttgtacatcccttggaaacgtaaataggtttttgaaattatctgttaaaagaatccacagattgacatacttataaacacaaacctattcgtagttgtgtcttcagtgggcatagccagtttattgatgtggagattctaaaagccttctgtttccttttagacttagagtaaaatctcagccaggttttgttttttttgtttgtttgtttgtttgtttgtttttttgaagtaacgtctcactccgatgcccaggctgaagtgcggtggcgtgatcttgatcttgactcactgcagcctcgacctcccaggttcaacgatcctcccacctcagcctcctgagtagctgggaccacaggcacacaccaccacaactggctaatttttgtttttatttttgcttgttgttttttgtagagacggaattttgccatgttgcccatgctggtcccaaacccccgggctcaagcgattcaccgatctcccaaaatgctgggattacaggcatgagccatcgtgcctggccttcagccaactcttttttaaaaaacacctgaaaactaaagtttttaaagatctaaagaagacagccagatcccaaaaccagtatgtcagcaaatgtttaggcacagattagtaaattttttctgtaaagaacctaataatattttgggctttgcaggccatatagtagagactatatgttgcataggcctaaatttatggtaagagtactgaaaaaaaattagtgttccttttcagatttctttaaaaggaataaaacagttctctgcagagactatacttgcataggcctaaatttatggtaagagtactgaaaaaaattagtcttccttttcagatttctttaaaaggaataaaacagttctctaaaagtgtttatagatttttttctgatttgttaaagacaagaattagaagtgtgggcaatgtactgataggaaaatgaatctctgactcaatttgcataaatataagggagcttggttcttaggcttaacttctgtattttattacttggcattactacgaacctgagcttcatcttgattttagtgaacttcctttgtacttggtattatatagccaaattttattatggatgaaataactggtaagctatatagttgtattggacatgcaggttccaaaaagtatttagtctgtggattcgtgatgtattggtctatcatgtaagtagagaatcataggcagaagctagtagttacaatttaatgcaacaagaatcttgctaatgcaatacaaccagaatctctgaaataattttgatttccacatagaatgcatgttcctcagtcactttatcataggtcagaaacatattagacttcttacctcctgaatgattaggttgcatggtattccatgtagaaaactactagatgcacatatctacttcacccttctgtagagttatttgagtagagttatatcttctgagtaccattctaagtaatgaagataagcttaatacaaaatatagctctttgaggactgggaatgtttctccacaatggagggacatagctgccagatactgtttccatctaaatagccagtatagcttagaagtgactctttcattgacttaaataaaaatttagtgaattgctgtctttgattacagaagtataaaagatgtggggttctctttcaacatccgttgttgtacttagagaaaacagagttacacttaattcagctgccaagatagcaatttggctaattgtctactgatcatttttgtattttttccagcttcaagacagacattcatgacattattttcagtcacacataaggtctttttaaagccttaatcacacacaaaaatgaatgaaatatattgtatttcttcgacagttctaaatgaaaaagtcttttttttttcaaattatccttttgtgtcaacatgagaaaataaagtagaagttttcctcttctagtgttggcactgctttttcatgattgcttataaaattgcgtatcattgaaagagacattaaaagtatccatttaatttgtgctatatagacagctaagaaaaataaattaatttgccattagaataaaaatcagactagttttcatcctctaagcaacagtgtgtctctaattttccacacaaacccaaaagagcctaactgaaatttctatgtagcctcttctctgtcattgctctctcaaagacacacagcttagtgtaagaaaaaaaattaatttgcaaagtagtatttcagccttttcttaggcaacccaagaaaactttggattgacgatgattgaattgaacaatgagaacacttggacagtggaaggggaacatcacacaccggggcctgctgtggagtggggggagggggaagggatagcactaggagatatacctaatgtaaatgacaagttaatgggtgcagcacaccaacatggcacatgtatacatatgtaacaaacctgcacgttgtgcacatgtaccctagaacttaaagtataataaaaaatatatatataaaaaacaagaattccatcaaatagtgggactaaaattcttcctaatttaactggaaggaaaaagtagagaaggagccttccaaaatctgtcacttgtagtgacagctatggaacccttgataaaatcatgatcatctccttagtgtgctaataaggaccacttgaggtattaacgccttgaaggcatcagtgcaaacatcaaggagatactctgcacaggtgccacagttcctggaaatagtgggaagaatgctggcagggtgatctttccttggcaggggcgggtttgcttattccatttacctacagggtgatttcccagtagtatttcaagctctcacaaaactaccaaacccaggccccaggactccagattttacttttcattgctgggccttgctacaagaaaaactttatgtctaagaagaagaacaccaggcatttatttcttatgtgatctaggtcacactgtcctgtcatgctactacaaatatacccaagaagataagcagttctaatatttattgagtgctatcaagatgcaaggcacttgaatatgtttccttatttagtgcccacacacacacaactctgaaaggcggttattattagaccccttttacagataacaaaacagactcagagaggttaaataaccaccacaagagcaccaagatgggaagtggtctagctaagattcgaacctacacctgtctgactatatagttaatgtgtttttccatcagcatttgctgggtccgtttctgggcaactgtgccaattcatatttgagggaaaacttggtatactggctgtcactggcatgaaccaatggaaaaaaaacagatatcaaattaagattaactagtctttgcttatcttttactcaaaaggaataattaaagcagcaatagaattttcagagtcttcgtattttgaggcctgaatatagttgagaatgtattttatttccaacttccattgctgaagaatttatgttcacaatagccggaggtacatagcaggaggagatagggggataaaatgttcatcaatatacacatcaaactctcctgctatactttacaaaagagtcccagcaacttagtctccagagctttagggtaaggcagtttcttagttcaaatcccagatctattactttctatttgatatgtagtaatttcttaatgtatgttagctgtaattatcattaatattaatcagcactgcagggaaaccatatacaaatattacaatatgggaattcgtgggtggagaggggttcctgtaaatatacgtgccatgattgttcacctaaatgtgaatattagttaagccttatgatagttcttttgtgatttaaattttcataagaataaggagacttttgttttaatatgttttttcttatcatctgaaattgatggataatacttcaggttttttcttgtaaatcatataaagaataaaaccagcagttacagggtggttggaatattactggaacagattccgattattagcccttttgctgcatttgacttactctagtaatttgaacttctctctcagagttctttcccctccctcttgcctgaggtctgccaagtcactttgtctagctgcttacatttgctacccttttaagtagttctggaagtttggaacttgcagcccacatcagcagatttgcccttttgcatttggcaagaatcagaatttgccatgtgtttccaaggagaggtgggagtatggtgttatagagattcatgtcagcatgagtctggaaacagtgattgttagataatcagtgaactgaagccagagaagagaattgagagcattatttttagagttgtttatatctgtagagatctacagcaatgtatgtattgcttttctttgaatatctttaggataaaatgatatacctttaagaggcatcatgtgatgtcattcattaactgaagcttcagaataattgggtctgaaatctgaggtaccctaaacctgactgagctcatgcagtacgttctttttaactctctaaaattatggctgcatgtaactgcttgctttaaaaggatgttagaattaggtgattgtacacttactttctcctcaaaactcaactgaaaataaaagttggtaggccaagggtaaggtagtgctggggaacatgatgttggaacagaatttaaatttcctttttttaaatgatagtttatgttcgtgaaaatatgaccagaaacatttagtagaatgttgacgtatccatgtctgtgaattttcagattactggagtgagagtgacaaggaagaagcagatactccatcaacaccaaaacaagatagccctccacccccatatgatacatacccacgacctccctcggtaagttagcaacaagaacattacttatcaccagattcttctacctgaaacatccttttgtatgttaaaaacatatgtagtagattgcatatcaaatttaaggtttctcagcggaaaagaaaactgggagtctaaaatcaataagcaaatttttttaagtatacaaagaatatttaagcaggaaaaacagtcattacagattccaggcagaataaatatgtcatcacttttattaacaaaatatactgtttgtatgaaggtagccttcgtggagataatcaacaacaacaaaaaagttttcttagaaaaaggtatataaaatgaccttatctattccacactaataaagtgtattcctatgtcctttagaatgaactcataaaaattaatattatatctatattgaagatatttttgcatgtagctttttcagcagccatgggacctggtttaatgtatatgtttgtatggtgtgtcagacaaatctctgtaaattactctgtgtatagactgtactttgatcttttaatagggtaaacagctggtttacttgggactgtcccactttatggccctttcccatcagaattaccaagagtgtctcagtaatgttccagtttagacaataatattccatggtcaggccgggcatggtagctcacgcgtctaatcccagcactttgggaggccaaggcgggcggatcacttgaggtcaggagttcgaaagcagcctggccaacatggtgaaaccccatctctactaaaaatacaaaaattagccaggcatggtggtgggcacctgtaatcccagctactcgggaggctgaggcacaagaatcgcttgaacttgggaggtggaggttgcagtgatccaagatcacaccactgcactccagcctgggcgacagagtgagactgtgtctcaaaataataataataataataatattccatggtcacattgccataagaaacaattctgcctatcttgggactaagtcttccacataggaaatagaagctggatttaggtgacaacaatagctaacctaattccatctcagtattactccagggggataattcatattttctctctttttctaaaacgtcaggatctggacaatttctttaaaatatctataaaagaggaagaataggaaacagcatcttcactgaacagctacttaaacatggcaatttgtgaatttcaagaagaaaactattcatattattattaacatgtgggaaggtaactgactgcccgcagaggatgccaagtaacttctcctcctttaccaggaggagtggtatgcagcttcacctcagtccggtgtgtcctggctgccacctcagccctgtttgtgatgatcacatttaacaaatcaggctcgacctgggccggtgtgtttgttagtccccagagctagagtaaggcttgtggcagtagaggtgcctgcaactatttcacagtgttcacttgatgccagtcctttttctggttatgttttgtgctataacatatagtcccaagctttaaattccagggataaaaattttccatttttcttttatatttatgtgccctgcagtatctatgctcaaggctaatggtaatccctagcaatgtatagtctcatcctgcctaacatttttaaccccatagaaagtaagaccatcagacagcttttctctggcacccataggagcagacattctcctatgaagaaaaggaagggttctttctgtttataggcagcctatcctcatatccaaaagactctctcctagtccccaagcccaagctacatgaaatcaggaatatgaatccagggacaatacttcttcaggatctgaaaatgtatagtttttaaagtgaaatttttgtagttgctgaattttcttatgtaagcactaactcttatacttgcattgttgtaaaattttgcattaatatgtcagatttttcatgagaccttggtatagccgcattccaatacatccatgtctctgtctcttaaaatgtaagctggggcctaactttgagatgtctgcaaacttgcctagtcattaacatgactacgtaagagttcatctacttaaatattacctggtagaaaccgaatgtgttccttggaatggaagtggtctgttattttggcacagactaatcaggggctcctttctacagatgagttgcgccagtccttatgtggaagcaaaacatagccgactttcctccacggagacttctcagtctcagtcttctcatgaggagtttcgccaggaagtaactgggagcagtgcagtgtctcccattcgcaagacagccagtcagcgccgctcctggcaggatttaattgagacgccactgacaagttcaggcttacactatcttcagactctgcccctggaggattctgtcttctctgactccgcggccatctccccagagcacaggcggcagtctaccctgccaactcagaaatgccacctgcaggatcactatgggccataccccttagctgagagtgagaggatgcaagtgctaaatggaaatgggggcaagcctcgaagttttactctgcctcgagatagcgggttcaaccattgctgtctgaatgctccagttagtgcctgtgacccacaggatgacgtgcaacccccagaggtggaggaagaggaggaggaggaggaggaggaaggggaggcagcaggggaaaacataggagaaaaaagtaagtatgtttctggagattcttagcctgtgtacacaaagtcctgaccttttcaaacttcttatttgaagaaaatagaaccttgcttcccttttttcttaaaataatagtattgctatatagtaagttaggtctcccttggtgacctactttcagaacttcagtaacttgggaaaacatgatgagtaatgaagcttataatctcaagatacccacagctggagcaaataatttttttctccaactagccatttgccttttaaggttaatggtgtttttgttttcttccttctcttatccactttattctcacttgcatgcaccatctcactggcccacagtggttgccccctgagttgggttaagaaactataaatgtttcaagcaggttgttagcagagccttggttgaataactgagtatacacacacacccactcacatctatacatatacatatttatcttccctttttattgtcagaagatttaaaggaaaaatccaaaagatagtttttccaaggagagatttcacatagcatttctttcaactccaaatagctgaatttgtttctagaaaccaattttccaaaagcatccatctaatttcttggtatgtgtgttgatcgtaaagctcaatttatgtgaatcaactcttataagaaaagtcaatgaagtaatcctctgccttgttgacattaagaatatctttactagttattaagttctttattcaacatgccataccaagcctctgtttattactaacatgacacatcagtccagaaacccaggctggtttaagggaaaggctgtaactcagttattttagtaagaaagaaaatctaggtttggctacaagtcctgaacataaaatgcacaaaacaaaatatatagaagaaatagtataaaactgttcacatctctttattcaaaatgcagtctgggccaattagcgcagataacttgagcaaatggtgatgaaatcacagttacttgtttggtacccctagggcaatagacttctctttttaaaaagatgaaagcagagtgtagccttcagcccattttacaaatatatgggactttgattacagaatatattagtgtaagttcttcatcacaaatggaaaaatatctcaaagttcacagattaccaacaggtcaagagccccatgtcagtgtcaagcttggctcatttaaaatggtagtctctttggaaatgactgacaagaaaatacagtggacctccctttatggtgtggatcttcattgcattatttaatattatctcatctaccaacaaaatataagaattgcttgtaataaaattcatatgctgtggcagtttccatgtgaagtatattttagccataatctccatgagaaacattataaaaggtacgttgttagtacaggaaaagtaattaccattcattacttgccaagccctttcaacattcacatctatcagagtttatggaagaaatatttaggagccatgttagtcctctgcaggaattctggcaagcataataataatgtttaatattctaaagattactaaaattaataaattgtcttctaaaatttaaagatgagttagaaacttcatttcaactgtcattcaggtactacacaactgctgtgactaagtatgtgaggtttattcttttacaaacattggagaaaacactttatctcagccattttaagataaactgtgttgaaattaggcacagccctctgaaatagagaattctgttcagaaaacatttcatcattcctacaggttaagtcactaatgttgtcttgttttgaataagctaggcacttaacagttcatcctggtcattgaataagggaagagtagaaagaagcaagcgtgtcctaagacatgaagggaaaatatggcaccatgcttgctcattcttcaggtttccagtagtccacagagcacttctagttagatagctttcaatttttttcttctagattatcttttttgttgtttagtggattggattttttagccaaatagatgcactcctaagttggttgggttttttctttacatttcagatgagtttagtgggtagttattcagtgctttccatctttttcagtgggctctctgtagaataattgttataagatagaacagacctagtaagtgtgtcagtaaatttggtattgtactttttgtctttatggttcaatattgtgggatgtttcgtgctatttcagtcagatctgcttcactgaaagtggccttgcactgtctttcaggccccatttctttctgggtattttttccataaatcttgccacttgatttctccgtgtacttcaaactgttcgtaacagagtagtgcattcatcctttcctggaagatgcttattattcaatgaaatgtatgtttgttctaatgatggttttctgcattgctatttctaatatttaggagtgggcaatttgatgaacaccttattcaggaaacatcagctttaaaaaccagtgttttcaaaagaatctttaaggtctagttatgggatgtcatgttcatggcttccctggattgaccattaggagtaagtactcaggctgcttgttcaaatcaagctgtctggtgttatgtcagcagagcaaaaattatacacggaaacgaagctgtggccattacatcagccttaacgtcctgtacatgtcctccaacacagagcgcttactgtgctgccacacagttcagcaggcaacctgtgcttttaaaaatcaaagtccaacagcagtgtgttacttactgtcctgctccaggccagcattcagtttgacctcctgaagtgaattgtagtcatcaagtacagaactgcagaggaaataagtttaatgtctagttccaaacgtttttctcagtttgccaagaaattaaaaataggaagtatcaggtggccaaaagaaataatggaagaaaacatgaaaatatagtctgtcatatgctttaagggtgaagaattatgtcatcaaccaaacctctttcttatcatttacgttttatcttaccttatatcacaatatatgttatatagtgcttatgagcttacagagcaatctaagaagcaagatatacctaaatccatgccttagctgtttttcattttccttatgggtatggaatttggccctgcttataaagtatatatttagccttccttagaacagacttcaatctgtgttctcgtagttgaactaccttttgccttattttgaaattcaattatttaactgagtcatactgtgattttcttaggctgaactcattttagtctgaaatggatggtactaaaagtacacaaatgagacctgtcttgttttcctttgactgaaaagtcagcttgcatattaattgtcttgacctgcttcactgacatttgagaaaagacaagtaatttcctgttatcccaattagcagtttcaaaccttacctggtatggacattataagacatcagctaaattaacttacaaattatgtcattctatgcacctttaaaggaatataaattatgaaagtatgggacaaaatatgaagatatatttcattcagaaataatctgccataacattaaaatactattttggttaatacagcttgaagtcagcttagaaaatctcgctttcctttgccgtatgtactagccaattcagatgaggttttgaaaaccattatcccttaatcctgctgattttcccctaagcaattataagggaactctcctggactcttgatgccttcatttactcggtgaagtcatgatgtcctttatcattgtcttgaagattacctaccagtattctcacttaatttacacgtatatgtagcttgggcttagaaatctaaagcaaaacctaggtcttttaagggggaataaaatctattaccttggagccactgtacacattagattatcaggctgaaatattattgacactttcaaaatgagatctgctgagaaatatattttaaggttatttttaaaaatctagactgagttttgtggctcacgcctgtaatcccagcactttgggaggccaaggcggaggatcacttgaggtcaggaatttgaaaccagcctggccaacatggcaaaaccctgtctctacgaaaaatacaaaaattagccaggcgtggtggcacatacctgtaatcccagctactaggtggctgagacgggagaattgcttgaacccgggaggtggaggttgcagtgagccaagatcatgccactgcactccagcctggatgacagagcaagactctgtctccaaaaaaaaaaaaaagaaagaaagaaaaaaaattagccggtcttataacctgctctataaataaacaaaataaataaataaataagtaaaaaatctaacattctttgtacactattaataacttaggagctgtgtagaatatgccactcagtagcctaaaatcttaaattattagggcataggggctagattatgagtacaaatacagagcagaagatacattaattcttgtcaatcattttaagggtcctatcttcatttcctgaagattttctaaaggtcatgaattctatttttaagaacattaaagtaggagatatgtagacaaggagaaggtattcccagaatatgaaattgtattgaaggaagaaaaggaacaagttgaaaataaaaatgttgcaacacttctcacttttttattatcaagataaattatatacacacacaaataattttaaagagcataatcatcattaatatcttaagttatagttcatgtctaaagggagtagatggagaaggatatacacagtgtgaagaaaaagacatgataaagtcaaagaaaaaatggcagagaaccttaactatatcacttttgtaaagttgagcacaccatccttggctgattatataacaaatatgtatttaaaaaaaacagaaaaacctagaaagtagtgagaaaattattttaatatattgtctgattttgaagaaatactgttagggagacataaaacactgaagattagctataattctgatactggttataggttagatttttaattacacctccattttttggctaaaaaaatgagagaaagttattaacttacaggaagttcagaggtggggttgttctggggtgaatttcatggcttaccaatgtcaggactctccattcatttttctgtaatgcaagagctccaagcatcatttctcatgagacagcattcaaaaagccaaagaccaggccctatctttagtcctttctataagaccaagggaaactttccatggatccttccagcagacttatacccagatttcattgccaaggttgcatcacatgtgcatgcctaaacaaatgacaagggaaatggaatgatatgaacagtttagactaaccttgatttgtttttatggtgatgagaaagagaaatgtgcaaaactgcttatcattactttctgcatgagcagctctattactgtgtatgttttgtcttcaaattatatttgttcaagcagtgtttcactttttaaatatatatatgcacatgcatagcccagatcacatcaccttacttaaaaattttggctctattgaaatgttagatatataaatgaagtaataagtattatgtaaccctgaaaatgtagcaagtttgatataattattgttgctcatggaatgaataagcatgttttcctatagacaataagtaatcctagcttagaatacagtctctggagatattcctcagttcaaatccttgctttgtcactgtcccacttacaactggtatgattgatcaagttatttaacacctctagacctcaatgtcttcattgtcaaatcatatggtaataatacctagcttttgaggttgtgtgagtattcaatgaagtgatgtcagaaagcaccttagatccatatgtgacacattataagtctgtccagtaaatgttatatagattttatataattatataggttttatatttgtttcatttatagattgatataattatatagattttatgtagatttgtattaaggcaaagcgggcaattacaatacttaaatagtgaattaggcctggcaaacctcattaagtaatgtttactacatgtcctatctttgttcagttctagccattgagttgaaccatacgaaatgttgcttttgtaggtcaaaatgatgaaacattagcaattttgtgtgtttcaacctaacatattagctgcgttctaggagtaaaatagaaatgttcctcatttcacattcctatcactcactactcctttcctttttgactttggacatttgggaactcaaaagaaaccttgcattccaaatagcaataattgtatcagatatatttactgaaatgtttatttatagatcttgtcatttgggtctcatttcaaatattttcccctcagagatcctttcctgacaacccagtctgacccagatgcccaccaccaccattcatcctcttgtatggttaccctgttttatatttttcccagctttatcactaggagtataatattaaatattgttcacagatttattttccatccctactaccagaatttaagcttcttaagagcagggattttattcctgtcttatagcacctaaaacagtatatggcccatagtagcccaggcactattgaaagaatgaatgagtgaatgaatgagtaatagctaaccccttttgttactaacttcctttcaattttattatttatagagctaaagttattttatccaacatatgacataaaacaaatcaaaacatcgcagaattcctcatttttggtattttgtcaaggaaaagccaggactacatgtgttcagcataccctctttatgctggagaccacaaagctgggatgctgataactagaattactgctcctcacattatggctgttttatggtcacattctctatgattgaaaccatttcctcctgtttcactgccatttcaaaaatgaaggccacaaaaatatgacatctgaaataactagttcattgtcataaatcagttagaaaccagatcttccagctctcttaggcagttgttcttcccaccaaaatccactgcctgtagaaggaaggaaaactcaaatcactgccagtgcttggttaacactcctagtcgtccattacctagcttcatcttaattagtttgtaaaaagtgttgaaactgcaacttgtactttggcaaataaccagtagccctgcatcagccaggaaaataatctcaaaagtgttagtaagtaatgacatcagatgtaaatggcaaaagaaggaattctaaatgctgtcaagtcacaacagcagaagatgtggccagaagagagctaatgctcacacaaaacaatgtcaacccctcactagcataggtaaggcaagttatgatttatgttatgttatttttttttactgagagagattattagattcagccacactgttatctgctattattttcacacatcaaaaaaaagcaaatcacttctcttcagctcaataatagcatattattcatttctccatggagtaccttctagcttattgtataaaaacctatcattctctttttaccttgctcacccttgccagagaaggccgaaggtcacaaatgcctcatttttgtccctcagcataaacaatttacctcctatggttggttaccaactaccagaagatggtagattatgatttaatatgattgcaccataaaaatatcttggagattttttaattaccctatttttgttgtgtaattcaaaagtaataacttgcttattgcaaaataaataaaaagtacagtgatgaaagtgcaaagccaccttctcttttctttactctccaaagttaactactgtcgaaagttaaggttttaaaaatcaattctggcatgaatttattttccttatatatctctatcttgtaactcagtgtgagttagggatatgaaggatggtttagttgattatcagttagagttcctctaaaacttttttgatatggcgttagtttataatgtaagcaacagtcctgtgaaataacttacgtagcaccttagaatccagcccaatcccaaaatttattactctagaaaatgtagcagttgaccttttcaaaaacaataggagaaatatgagaagaaagaaatggcattggctgtatatgcacactcactcatacactgccccccccacaaacacacccccccacacacacaccccgactcatacatcagaagttctcttgcctacttgcctaatgccttgatgccttatggattttgctgagctttctttatgaagatcttccagtactttcagtttataccaaagctctgtgatgaaagagccaagccagagccaattagaaaaaaaattagcaagtccagccttcaaaaggcagaaagcagaacttggatatgggcttcatagccactgagtctggtgaccagtttacctacggattttagcttcaagttataaaacactgaactttctactaaacaatctctcctatttccagtgttctcactagtttcatactactagccactcagactttcttatgccgtgccgtaggtacatcttggcctaatatttggtcttaataacataatctattacactctaaaatttgtcctttaatgggaaaatattcccactactatgtcattcaataaggaaaaagtgcccattattatatttttaagtggaaaatttgatcttaaaaaattaatagttaaacctcatacttgaaaacttagagcagcttcttgtctcaagaatgacaattttgtatatttttgtttttattacaaacacaaaatatgccaataaaatcaactttctgggttatttcacagacatttttggaatacttgaaaataagagttatagttgtgtaaatcactgattgacttcagagcttttagagccacaaactctttaacattcttactcttagattttctgacatttcaatatctagatttagccagctaaaatgcaaactaagtctctgtatcgtacatatggtttgctgtatcaatatataattcagttaattccaaacatgcattcatgcattcaacatgcatttgtttatttttctacacacagggtaccatgttaagagcctgtctagctcttccataagtctacttacaacagaaatgtgtaaattatttttaataaatgagattttttctttctgataacatgaaacacagagagtaattccaaatatgcaacatctttgttaccttataccagtaattttccctagtaaccagtttataattttataaaaattattcattgagagatggtgcaagatattttatttttatgttaattacttatcacttatgcaaaatttataagactagttaaaatcagatgagatcacttaaagagctatttctgattcagcttattccttaaacatcatggttgaggaatatgcattctggttacccagttgtactgattaacacaaatcagatgtctaaaaatcaatgaactgaacttcatattatactgaccatagattaatgtttctttttataattgagaaggcacttcttaatgttacactataatcattgtagaattttattattggaaaagcctattaatatagggaatattagcagagcattaaatacagaaaattgtattttgaatgtctattttagggaaatttgaaccttaaaattttaaatagtttttcatttccttccacatttgaaatccctaatcttccatgattttgaatctgttacttttactgcactatttctcttttgataaatcatccgtagaatgtatttacttaatgcctaagatctattcacttaagacctccgaattttctcatctatgactttattggctattttcgttataatttttttttaatttttgttgttgtggcccctccactgctccatgactgaatttagtttattctgtaacttacgaaatggacactgtaaagcatacaccttgagattcttggtgagagaaaatagcccataactttgatgtcactaaacttaaactgtacacatttttttcctatcatctctaatgttttctcctgttctttagcaatgccaacacacatgggttcacatgccttttcttaaaaaaagaaaagaaaagaaaacacacggggaggagggacagctggaatcagtgtggctttaatataatacataagcaaaatctgacaataagccccacccctcactttgaattctgttatctttttaaaatcctatgtagttgctgggctgccttctctttatttagcatcttgggttcttagattcatgatgtgcttttattgacttaattaaaaggattttgcctcagcactagaggtaggcaagatgtttatcattacaaaagtaattccgtagaaatactgaatagctttgctgaataagtaactgaaaaggtgccttaactgaatgcttctttaaatttttaagcatctttttttaatgtgtcagtggtatctctctggcaaatggtaaatcactgatttactattaaagatgcttaaatttgtaagcatctttttttaatgtgtcagtggtatctctctggcaaatagtacagtacctattttaaaatgttttatgttaagaaaaagggttcatttaagagatgaattgtttttaactgggcttggcatggaaaatgagtcatgctgtatgtaaatatgcatatagccctctcaccatagaacttagagttttgaggcacttatcttcactttctacccaaaagagaaacttttgcatattttaaaaattgttattgagcctctgcttgaatattttaaagactcggaactcccgcctccaaaagcaggcatttcatgttgaagagccttacttacagagttcttccttgtattgatacaaaaacaaatttctgccaaactttctactcattgtggatcttaaaattgcaaattagaaaaatgcagagcaagcatttgaaagcctatcatgtggaaagatggacaagatagtctttgaagttccagagaacatagtagataaagggcacaaggaggctgattttagattgatatggaaaaaaaatccagtttttgcaggtttataacttacgagtttagtgggctcctcattactcgaagtgtttaggaagaggctgaataaccagctaccagccaggaattcccaagttagctggaaagttcaacctgatggtttcttccaattctaaagttttatagttctcttcagcataatggtcttgccctttgctctcaccatatgccttgcacattgtatatatctccaaaactctaaaatggaattgtgttatcaaacataatttgtgttgtctcttcttgaggtgtctttatgcctgtgacacatgagttctagataactcatcatcctggctaccctcatctggactccttgtttctttatagagtccccatgctaagtgtattggaactattacagtgatctagacactatacttttgttaacatgattacattagttttaacctgctcactgttggctcatataatgctttaatgttatcaagtgataagcattccacttactttattttttaatctaagtgcagctatttatatttatttctgttaaatttttaatgtctcatgtttcacccaaagtatttgactctgttacaaagtttagaatctcagttttatcatgtatgatattactcatttctcttatcatttaataatcctccaaaattctaagcaccctttctgtgtttttaactgattcatcaaggaaagtacattttttaagaaaacattttaaggaagaaaagaccaaggacagagatttacagcattaaattttaaactttttgtgttaattttattcagtcattcaaagtctttatatagatccacctaatagtaatgtcattcagcccatattacagtatctttattcatagggtatcaggtaaaatttcatcttatgtaagacacactgcccagggttttcctcttcccttccaacttagagatactgtccccaaaagaagtcattttaaaatgcttcatttttttattaaattcatattggtttgtcaaacgaaattaaaaaacaaaacgccacccactcatcatctatttttacaaatttatatttatatcaggtttatcaatatgttcattggagaactcatgctttgtttgtttggataagagggctcttaagatttaagcattaagtcttatggaatgctgacagtagccctaagataatttccaaaaagtttattcacttgctaagattataaccttctagtttaaaggaaccacagagtggttcttagtagtcccttgtctccagaagcatttatgttttaatgccctagtttgaagactttttctcttgcaggaaaagcctaaattgtcattgaaggcattatagttctactttttatcattgatattttcttaatttttctttacaaaagctttgtatcttcagttttttcataagcttcagctgaacatttgcctttgtggagctcttcttacaaacaattggtattattttctacttgttcatttctcgtagcctcttattctatattttatagaaatcctccttaaactaaggcttgttctaaagaagttccttgtaactaccttgacttcatctgcatctcctttccctccctcattgggacagtttacgtttgtattactggaatttaattttttaaaagtactgatcattaaaactttccatttgtctttgtaaagttttaaaatcatatctttaataatctaaggtccatatccagctatgtgttctttctcctcaccactagaagaaaaaacaaaagcaaaattacataatgtgtttcttttagttctctttgtgccataaaagttcttccctgttgttcagcattagatcccaaatagattccaaatatttctttgtatttctgaaacatgaaaccatcagggtttaaatgcatgcagtaattacttacatgtattgatctcattttcaatgcattaaatcctataattagtatattgatggcttgaccagaaaatattgaagttcaggttatattattttatattttttcatcttcagaagattttatagaaattgattcaacttttagcctacaaataataggaaacatgacactataaaaattaggtgacttcattaggacaatttacaatatttttaagcctgtgttcttgcatgcctcagtcaataccagaatatgtttgtatagagtattggaaccctacagacctggttggacttttacagatctagtaagagtaagaaaataagagtaccatagatttctaatagtttgtttttgttagatccaagtcctaaccctgatcagccatattctttagtcaactgtattcagtggctcctaagaattatcatttctatactatgccccagtttacattctttataaataatagcttcaaattacagaaacaagttgcattcagacttcttcattttaagcccttttacctaaagtaataatgacttggtagtataaaactgtactaccaatttctgctctaaagagcttatagaaattggggtgatatttgagtatttgtttattagattatcttgctgtaatctatctagtgcaagatacttgctgcctgtctgtaaaagaaaagtatgtttgttgaaggtaatctcttccattatatttttagaaaatacatagtaacatttcaggatgtatggtttaatgaagagtggtgttgcaccacattgttgatgctccttgatattttcacacatagccagtgatatacctctcccaactgaataattaacatagctgattgtaaaaataaacaaacttgatttagcccttcaaaatttatttgcctgtaattcactgagcttatacgtattaaacaaaacatataataggtacttcattgtcatggaacccaaactaaataagtattaaataaaactcattcacggatttataccttacaaaatactgcatattgtcagaagaagaaaggcataggtgtccaaaaattggtttctaattaattataatatggataatttttttaaaaattgaataacttttttacaattccagccaaaatttagcatgtcctccattatatggagcagtgaatttaaaaattactttcatggttttagagtttgagacagccaaattacacaaatgattcactgtttaaacatcaataatatttccactggtggcataaaatcaagcttcaatttctaaaatgtgtatggaaatcctatgcattactgatatttagaactacctttttggtatattgagatgattgatattaatcaggagccctaaatcagttgataaactattttcacaaaatgcagagatattctattttactttgtgccttaaattttaaagaaagaaagaaaacaaaggaaaaagacataatttagtttgttttacttgacagtcagcaaaagtccactaagcagggtgtggctatcatcccaaaggtgaataataacagcaatcataaactggactgatcatatatctgaacaatgcctaaaatctcaagaaccatttattgtacttgcaattgagtgtagtgtttaaaatgatgagaattttgcctacaaaatcataattcctgtggataaagaatgggcacaaactgctatttttctctaatataaaaagaaataggctacctctaagtttgtttttttgtttttttgtttttttttgagacggagtctcactctgttgcccaggttggagtgcggtggcgcgatcacagctcactgcaaccttcacctcccgggttcaagcaatttccggctaatttctgtgtttttggtagagatggggtttcaccatgttggccaagctggtttcgaactcctgacctcaagtgatcctcccaaagtgttaggattacaggcatgagccactgcatctgcccacccctaagttttctatcatgattgttccaaaaggtagaattatgatgtattaatttatctgcctaaccaaacttttattctattcattgcacagtttctaaaatcagagattatcttaaattgacaatatctgacatatttctatattatcccccaatagctcataattcaggtggttgtaacccaattaaatgatagaagccatgaggcttgactgagtaaggtagaatactaattcttattttttcattgtctctaatgaaatgactgactttttagaaaagccatttaatttacccactaatattataaggcatcagatatttttagagaatgcttttttagaatttaaactgactcagttttcaaaaaaagattattaaaataaatgcacatcgtattctaaaagtaaaaataaaataattcaactatttgggtaaaatttggtgactctttttctgttaaattttcaatatttgatggaaatgaacatataatacatgtaacatggcattttaaaatgttaaaacagtaactaatggttatgtcacaatcatatttattttgcctgatccatgtggtacagaaacctagccattcaaaatctgtttaaaggacaaagttttacacatagcaataaagctgtatcaagcaatttggctgcaaccccttccaacatttccccaaagtagcagggtggtgaggttttttatagtagttccatcaatctgcttctatcaacagagaaggacctttagagagtatatttttaagttatatttataattaaaatctcatcctgagtctaagattttgtcttacctcatctactcctaacattaatgacatatgaatatcttgacaatgtaggtcattcaaagaaaacaccctttagcagtggttacactatcatttcatataaggccaaaatcatttttccttgacatagcaagcagtgctagaaatagcattctttgacctcagtgacttatcttcctaagatttccccctctgctacatagttcaccccaaaaactttaagtagatcttctcacttcaattgaaaacctagtgaggtataaagcattttacatagttgtttaatagaagtctattcagtgttcagcttgtacccgcaaatactgagattttgaattaagatgtatttgggcaatttaattaattcaaataatatttatggaggcaacacagtgtcctgagtacccactctgctaagtgctggaagaaacaaagattttaaaattacagaatcaataaattcatcatttaatgggagagaaaaacatacaaatgtaactgtacagtatattagatgttttgagaaatgaacacattaagttctatgaaagcacttaagaggtcttgattatctctaccttgtgaaatcagacaagacctcacagaggatgtgacattcaagctggatgaataaggtttcaccaggagaaaaagaaaaggagggtacattctaggtggtaaaaaaaaaaaaaaaaaaaaaaatggcatcagcaaaggtagacaggaagaaaaacaaagaataatttagagaaatatggtatttagtgtagatgagtacagatgagacaaagatttatgttagaaatgaattaaaaaggtcctaacataccatgtttagaagtttggattgtatcacaaagaacatgatagagagcttcggtaggtcactctggccaatatagatgtattaatgtgggagaatacaggtgatagggataccaattagaaaactaattcaacaatccagatgagagatatgataccctcccttgacaaatgtggaggcaaaatgttaccttctcagaggaagatctaacagatagaaagtaggtcttgaagagtaaaatggaaacttggagctctcctaatgaagaattggatattgggctaaccaggcactaataagaggtctgccaagtagccctgaatggcctgaagtcagaaaacacaaatttagaatggtgacaatcagtgtgcatatacagttttttctagcaatgcccagtggccaggcaggagtaagaaagcacatattggaacaagtacatgtaatacatatccaagagggaattgaggggtctagtcagaggggtccaaattggataaggaaatgaattcaggagggagctggttcttaataagatcaaagactagacattatatcatgaaagagatggaaagagaggaaactatattcagggaaagctgtaatatttaggaagtgacatggcttaccatgatgacaagctcaaatgtgtgttgattttggattagacagcaagaattcaacacagagggcacttattacaaagcaactcttcaatatgactcttttacgtttgcatcttgaagaaaaaactttggaacattttgcacgtgagcgtgtattagtctgctttcacactgctgataaagacatacataaggccgggcgcggtggctcacacctgtaatcccagcactttaggaggccaaggcaggtggataatgaggtcaggagatcgagaccatcctggctaacatggtgaaaccctgtctctactaaaaatacaaaaaaaaaaaaattagcctggcatggtggcaggtgcctgtagtcccagctattcaggaggctgaggcaggagaatggtgtgaacccgggaggcggagctggcagtgagccgagatcgtgccactgcactccagcctgggcgactgagcaagactccatctcaaaaaaaaagacatacctgagactgggaagaaaaagaggtttaatggacttacagtgccacatggctggggaggcctcacagtcatggcagaaggcgaggaggagcaagtcatgtcttacatggatggcctcaggcaaagagagagagcttgtggagggaaactcccatttttaaaacagtcagatgttgtgagacttattcactatcataagaccagcacaggaaagacccacccccatgattcagttatctcctgttgggtccctcccacaacccatgggaataatgggagctacaagatgagatttgggtggggacacaaaacatattattccacccctggcccctcccaaatcccatgtcctcacatttcaaaaccaatcctgccttcccaacagtcccccaaagtcttatctcatttcagcattaactcaaaagtccacagtccaaagtctcatccgagacaaggcaagtcccttccatctatgagcctgtaaaatcaaaagcaagttagttacctcctagatacactggggggtacaggcattggataaatgcagccattccaaatgggagaaattggccaaaacaaaggagctacaggccccatgcaagtccaaaatccagcagggcagtaaaatcttaaagctccaaaatgatctcctttgactccatgtctcacatacaggtcacactgatacaagaggtgggtttccatggtcttgggcagctctgctcctgtggctttgcagggtacaacctctctcggctgctttcacaggctggcattgagtgtctgcagcttttccaggctcactgtgcaagctgtcagtggatctaccattctggggtctggaggatggtggccctcatctcacagctccactaggtggctccccagtagggactctgtgtgggggctctgaccccacatttcccttctgcaccgccctagcagaggttctccatgagaaccccgtccctgcagcaaacttctgcctgcatccaggcgtttccatacatctgaaatctaggcagaggttcccacacctcaattcttgacttctgtgcacccacaggctgaacaccacaggaagctgccaaggcttggggcttccaccctctgaagccatgcaccaagctgtaccttggccccttttagttatggctggagtggctgggacacagggcgccacacctgtagactgcacaacagcagagagaccctgggcccagcccacgaaaccactttttcctcctaaatctctgggcctgtgatggaagggactgctgcaaaggtctctgacataccctggagatattttccccattgtcttggtgattaacattcagttccttgttacttatgcaaatttctgcagccagcttgaatttctcctcagaaaatgggattttcttttctatcacttatcaggctgcaaattttccaaacttttatgctctgtttcccttttaaaactgaatgcctttaacagcacccaagtgacttcttgaatgctttgctgcttagaaattcttccaccagataccctaaatcatctctcaagttcaaagttccacaattctctagggcaggggcaaaatgcccaccagtctctttgctaaaacataataagagtcacctttgctccagttccccacaagttcctcatctccgtctgagaccacctcagcctggatttcattgtccatatcattattagcattttggtcaaagccattcaacaagtctctagggagtgtcaaacttccccacattttcctgtcttctgagccctccagactgtttcagcctctccctgttaaccagttccaaagtcacttacacattttcaggtatcttttcagccgtgccccactctgttggtaccagtttactgtattagttcattttcacactgctgataaagacatacccaagactgggcaatttacaaaagaaaaagctttaattggacttacagttccacatagctggggaagcttcacaatcatggtggaaggcaaggaggagcaagtcacatcttacttggatggggtcaggcaaagagagagagcttgtgcagggaaactcccatttttaaaactatcagatctcatgagtcttacaagaacagcatgggaaagacccacccccatgattcaattatctcccacggggtccctcccacaactcgtgggaattatgggtgctacaagatgagatttggatgggccaaaccatatcaatgtgtaaagtaagttatctaatggcaagagggaaacacccattgatagggaaaataaatcccatttatattaacagtatttatgtattacatttcagttgtttagtgaagtatattcaatgaccatataatgaattatgaagaagtgaaaactgaagctattttaacttgctatttccattctaaagcaaatctcaactcatttcagtcaggtttacatcattaactgatcagtctttgaataaaataattttaaatttgatatcaagggcattctgaatagaatgactgaattatatttatttgtccttttactttcactgctgtctcaggaagactcttcttatgttttctatagatgatacctctctgttaaagtcaaagacattttagtgatttatcttttttataaagatatgccacatagtctggatttgaaatgcagtctgcaaagccaggcatgcccataaatctgaatcttttattcttttctcatatagaaaaagaagatatttttacacatggataaaaatactaaagtagaattgcctttctcaaggtaaagccaaaacacctatagtgtgatgcagtttgtttaaattttataggtttgttgaacacattaatctattacaaataatagctaacatttctaatgagtacttactatgtgtcaggcactattctaaggtctttacgtaatataagtcatttaatccttacaacaaccctgtaagggaaatactattattatccttatcttctaagtgaggaaactgagtttaaatagcataatccaggactcccagctatttaataacagacctaagattcagacagacattgtgacagcagagtgaacactcttaattgcatattgcccctcagacttataattttaatacaggttaaaatttagcaaaatatttttcactatatatgtatataatacacacacacacatacatatatatatatattgacctacataaaaggaattaaaatttttaggttttattacagcagcaccattaatatggttaatcaagtaaagcaaaaatgttgttctgatctttcaatcacatttacaaaaatttaccttttattagtagaaattataattagtgtactttccaattttaaccagtgtccaaaaatcatgtactgtgatgtgtataaacagtgaaacgagtccaccacttgagtcaaaaccctttcttagtattttaagctttgacatgattccttttatagctaatttttaatattgggatttttttttaaaaaaaaagaaaaactggctgggcccagtggctcatacccagcacttcaggaggccaaggcaggaggattgcttgagcccaggagttcgagaccagcctgggcaacatggcaaagccccaagtctacaaatacaaaaattagccaggcatgatggtgtgcacctgtagtgccagctactcaggaggctgaggtaggaggatcacttgaggatgggaggttgagcctcctgtgagctgtgatcacaccactgcactccagcctgggcaacagaacaaaaccctgtctctaaataaataaataaataaataaaataattcccaagaattaagtctggatactggtttgaaaattatttcatatggtgactaatcagaagttatttcaatttttccttcgaagttctactttatacattttgtggaaacaatccaaatatttctgcctatttatttatctatcatttggtggagatataaagcagtagatttatgagtaaaattcagagataccactgattttaccaattcctactcacagatgccaagtctgatatattgtgtgtttctgtgtattctctcatgatgaaacattacttttaatcacctcttacaaatcggaagagtaaatgcatgtaacctgaaaagaactattaaagaatgcaacattaatgctttaatctatttccaccttctaatatctcatgcagtatgtagaataaaataaaaactcataattctcacatttcctgcatcttctttcaagatattgcatataaaactacttcgtaaagtagaaagtgaaatgcaaatgttagtaccataattattattaccgagctaacatgctaaattggtttgccttcaaaatgttaacaccaaattgaagagtaaaagtttttcagtgataattcttaggattccttgaaaaaagaatactaattagaatatatgatattttgcaaaaacagcaatacctccattaaattcctagctcctctttaagaaaaccagattcagaactagtgaataacttattacttttatcccatatgttctggcttttgattttacatcttagtaataagttgatatgggtatctgtaacccacccttcttagcaggttgccatgacaacctgaggtaaagtaccagttcactggagcttcaggctttgtccacgctaaatacaaaagctgcatttgatttcagcttggccgtttctgttgggagcaatgtaccacagttctttccacttccctggctgactttttcatcaccatggagaccagatctgcccacacaactaagatgtgaaaccattcctcatatggctaaaactaaggccttggttcccaaggccttttttaaagtatattactttgttaaagaagagttcctgcttctgcttttaaagtgtttattgattttccacaaagagaaaacaaactttctggtgctgaagatttaaaataaggagaaagaaaatgacattttccttggtcagtttctggttttgtgtgtactgtattcatggtgtgtactctgcatagtcaattactaaggaataatgtttcatttcaaattatatgacaatattcctaaatagtagttcacacatttaatgttcacttgatggtgggcttaaaatgtgacttttagtttgagatttcctaaatttgtcactaaatccaatattagtatcttttagattagttctgcacttccaataaaatcagtatgagaagttattctagaaccttgatcataagtatgcatggacttaaggaagaactaatgtaatttatcactacaaatccagttatagcatatccagatagatctgatgaattagctatagaagatcatatagcccaatttttaatatattcttgcatatgtaaatttgtaatgttagtatgtgtatataggtgttcatgtgtatacacacttatataatatacacacacacacacacacacacacacacacacacatacagattagtaccacaaatagggtcaaagttccacagagttctttgaagatcacatttgttatggagatactaaatactttacagctgctattatttttttgccatcccctcccggaaaatggcatcagtcaaaggagatggtaggaagtcttaagtggtgttgggaatcccaaattcaccccttgatttgcacattcctcaaagtgacttaggatggcatctcaactttcatggttgtgttttttaccctagagaaggcaacatggcccttgcttaataaaatacatatactaaataggaattccaaaaaattctgacttcaataaaacatagaattgttcttattttttaaaatatattatgaataagctagcaccataaaggtgccgtaaattagtttacagatgggaaacaaatttattaacataaatgaattttttgttttgtttactagcaagaagttagcaatccgttgctatatttgaatacaaattatgttgtaggatacagagaactttctgacatttcaaacatttgaattttgcaagaggaactcactgcaatgaagttcctgtatcattccagttttctgtaattacgctggagagtgtgaaattcaacatgtgatactaaatgttaaacacagatatagctgggaaccttttgcaatggctataaagtcatttgtatttttccataagaacattgagagtcagcatatctctaactctttagtggaactttctgtaaaagggcagtgccatataattttgtcagaagggaaaaatgaaaattaatatacaatagggcatttttaaaaaggatattcttcatatgttgttagattcaatagctttccatcccaaatccaagatgactttgctggtccaaaatttaacaaccagcaatttccaagacagctaagattgaatatgaaaactcattacttgatttttagttaagatgaacattaatgctaatttgtttacatctatgctatatttcttacaaacatgattttgtagtgatttttaccaaattaatgtttttcttcttgtcatgtacacaacatattttgaatgcctaaaaatataataatttgaatgttggaataggcagatgacttaacaatggggatttttgaggattgtttatgatgtaattattgtagattagaaaataaaagaatgtgaaaataccatggattaaggtgagagattagatttataacaaatttgacataaagaaaaaatcttaatgataaataactgtcaagatacaattttagattcttacaaatgtttcttgaattttcttcttacctttctttggcacttgccttgctggggaaggtatctttcattgtccttaaattcaactggcagtgcccctaaagcagctccttcttgccagagttgctaatgagcaaatgatcccaaatgtcagactggtgtgccaaggaggttattaataaggcattaacatttagaagttattgatggaggaaaatcaatattaccatctttataatattgcaagctcagttagaaagagtaagcagaagtttatttcaggcttctacaatcataaagaatgttacagtatgggaggaagtaatgtctttagatttttagcataagaatcaattcttattctgctgtcagtaccccgcattagtactggagctaatgctgaatgatattcttctaataaaaatagcagtaatcctcccaaaatcaagatggcagtactttgaggatagaatatgaatttaatatgagagtaagaataggatggactagacctgtaggacaaaagttcacaaagatctatgttatatatatatacatacatatattcatttattttagtgtgtgtatatatatacactaaattcatattctatcctcagagtactgccatcttgattttgggaggattactgttatttttattagaagaatatcattcagtattagctccagtatcatgtcattcctcacgattcaattaggtaataaaagaggtactgacttgcaaaagtaagtgaaatgttaaattcttttcaggaagaatacaacagatagttctgcttgtgtgtgggggagtgctgacagcagaataagaaaagaattgattcttatgctaaaaatctaaagacattatttcctcccatactgtaacattctttatgattgtagaagcctgaaataaacttctgcttactctttctgagcttgcaatattataaagatggtaatattgattttcctccttcaataacttctaaatgttaatgccttgttagtaacctccttggcacaccagtctgaaatttgatctaaaataaatgtgtgtgtgtgtgtgtgtgtgtgtgtgtgtatatatacacatatatatgtatatgtgtatatatatatacacctatatatatgtatatgtgtatatataaatatatgtatatgtgtatatatgtatatatgtatatgtgtatatatatgtatatataaatatatgtatatgtgtatatatgtatatatgtatatataaatgtgtgtgtgtatatgtatagatcaaattttcaagacttaggaagctgtgccattggttgcttcccaaagaagctgagcagtaaaagtataatttgcatagcattaaaatttactgaccacagatcaagttagctgatcagcatcatggcagaagtatgtaagggcaaagtcctttgtttacttggagtgggttctgatgaagtgaacatactaaatgtatctccataaccccaactccccaggcacacatacccttatctattatttcaccagaatatcaatttggaaaattcaagtcgagtgtgatggacaaattaaatagcgtgggtcatagatgtataatcagtgttctgaagacatttttaccacccagtcatataagtgaaccaagattcagataaggttggaactacttttcagagtacttatcaggtaggaaagagaatgtcctaatagggtttgaaggaccaaaaagaacctattaaaggaaataggcaagaaaactatgttgatagagttgatcccaatttgccttttcattttgacagactagatgtagtcacaaatgaagtgttgaatgactcacttgttcaccagactggcagttctcatcactgagttacttcacattgattatcatccaggctgaataaaatctaattacatccttttaatacaaacatacaaggtggtggtagaaaatccacataaatttaaaacctgcactgttcatctctaaagtatttgggagttaaaaaaaaaaagtctactattttctgtcgggggttcatgtctcagacttcacctatgttatctctgtaggtatttcaactggaactgagaagtttaaggagattattttaaattaagtcattattcatcataaaatggatttcagaagcaacccaatctgccaatagcttgctgtccacctacattgctgaaagaaaaccttacccaggaatggttatttttactaaacttgtctcattggagtttaatgtgattcttctattaataacctcaaaataacatctcctgaaatatttaaaaatatggatggattaggatggaggagtcaaatatcaagtcaaatacagtagataattcttaactataaaattttaagatagaagtgggaaggaggtatacaactatatcataatctttttgaggtgagagtgttgtctttgtatatttattcctaacctttgatatagtatatatatatatacacccataggcacccattaaacctttactgaacgatatatttctataaaaattaattatttccattttccattttaaaatctgaatggcgacatttgcaatgacagtatcatgtgtcaaaattccatagtacattttcctgaaatatctacagacacttcattgaaaataaactggttgtaaattaaaacaacatgttaagtacttctgtaactattaaatgtgaaagatgtcttcagttgtttcgtaaaaacttcactcaaagggtacttcagatctgccttaatttcagaaagttgtttttaatgcagattttagaaagtcagcatgtgtgatagactcctggataagtaattaagtcataaatggcactctaaggtcataatataacagtaggtggattaagatgaaatactactttcataaggaaatactccatgtcttgtgatttatacacacaggatggaattgtgatttgggaatttagaggaacactcaaattatctggaaacagtattttcttacctgttttgcctatggcttaggttcatcaaatattttattttacccggaattgtgaattaaagaactccataagtgctgtaagtataaacacaaactatattatctatcactagttaccactttatttagaaaaataatattttatcatgaaaattttgcttcacattcataaaaatattttccaactccttctccctatggtattaaaaaataaaaaaaatctttaatatccagtctttttgaagtcaaccttttatgagaaaataggccctcaaaatttggacagataatactcaaaccacaattaacaagtctctgttttggtctgaacattctgaaccaaggtatgagcccactgtctccaatacttacatagagaaaagtaattatcactatcatttcatggtgttggatatccttgtttttgaaaaagaaaaacttaaatctaagcacatacatttagaagaaggggaggctccaaataactatgttaagtaaataaggtttttcaaaataaacacaaaacaattctactctcccaggagtagaattgtgttactcttgatagacttgaatatctgctattgatgacctttgttatccacaaatagcttaagacaagtagtccttggctttgcccttaaatttgccctcaagcatgctgattatggaactgagtgaaatagaattgagttctgtcttagaactcaaacagaattaggaatctttgtaagtgctcaactggcttaaatacttacttccattttaaaatattttcttctctttcattcattaaagaaaatatttattttcaactgttttatatttagccttaatcattttcttgaagatgttcgtacctctacccttatcccctctataatctaatcctcctcaggcatttgattgaagtatcatcagctatttttagcaggtcactaatggaagcctgattatatttctaaaacttatgtttccagaatttctatttcttcttattatttgggcggtcaagttttatttggggcaatgtttaaattcataaagcaaaaagagaaagaaacatcctcctcaagatttcctatgcaaattcaatctgtgtctcaaggaacttgcatggatatggaatctcactggaataagtcattctacacatgattcaacatggcattccatctgggttcatcattcagatctccaggagtatagtaacagggaaacaagatctgtttcttcttaacctaagctggtggcctcacaattagaagtttcagtgatgagtagtagcttaataaatatttattaaataatacgccaaacagaagcattactgattttctttgtggtatcatagatatgttgctctcatttcaaaatgtaattggctaaaagcttggtaaatagtgaaatttattttaacagcagcagtagggaatatttttatagttagagtaacagccaaaagaaaacaaaataatcaagagttatataatttatgttttttctgccttctattgttttttccatagagatggggtctcactatgttgcccaggctcgtctcaaactgctggcctcaagtgatcctcctgtctcggcctcccaaagtgctgggattacaggcatgagccactgtgcccagcatgcctttttctaaagaacatgcaatttccatttgttcttttagaaaagaggaataaaattagtctgtataataattttaactggtttgactattttgactttgtatcaggataaatgaagttgtccactacaaaggagaagggtagtaattgagaattgaacacaaagaaagagaaagcccagtgaaaacctaaagggagagaaaaggaaagagtgttgagaatcagaatgggacttgtaaaaagttaaagacacataaacatgagattcacagaagtccaagatagaaggacagtatcttgaagtaggtttttgtgttttagagatttcatctagattatacgggcagccctttgtgcacttgcttctgacccacctggctcgccagtacacgtatacttaagattcgtaatgcacatgccaagacatatagtggagttgagtgtaggagtgccgttgtagtttcttgtttgcctcaaatataaataggcactatttaacactacataaaaagtatagttctaaaaaatttatttaaaatttaccaaggcctctttcattttgccataatctcagtagaccaagatatttccatcagattcctcagcaaaaatcctgaaattgtttaagctgtgtgatacaatgtcagactggtgatgggattaaaaataaaatgctatgtgaagtccccaaactcagggcttctgacttagaaactacttgtatatgcagtgcaaaaattgctgttactccaaccagccctagccagtgtgattgacctaaagcaagaggtctcaaactgcagtgggcacaagaatcacctggattgcttgtttaaaatgcagattcctgagttccatacccagaaattctgattcaatagatgaggtgtagggcccagaaatctgtgtttaacaagcacctccacccccatcctgagattcagtagtcactagtactgtgagcactagtagttgaagagataccgtgccctagggagttatcttctcttatgctaactaactggtagctagttgtagccattttgaaatagtacttctccctccaccatcccttaggagctaaactgaggagatgtttccagtctcttgcaatagaattcggcaattgtgactcgattaccagggctctagttcagtttagtgtgggttaagtgggcattaaggaatgtgtattagaaattaaaaggttcatgtaaccttatctctgtggggaaacaaaggatgtgtttaggataactacaaaatgtttgaattgcttagataaattaagaacagtttaaacttagaaatgaccttgtgcccaaggttggattccctctgattttgctgtgtgaaattccatgaccttgtgaaacaaagtggtagaagctaaagctagcattccagtattataatattctaaaaactgaggtattgtgttttgtttcgtttgacctgtatatgaagattattcagtttccacccccatttctgcaaaaagagtataatattacagacaaaaattagttccgctgatttctgaactatgctatatcttgtttgctagatatcagtgttataggcaagatgtgtccctccccattttctaagggaggacataatgaacaacatgctttctctattctctctcccaacttgttccttcttttctcaatatgactcaaaagatactacaagatgttgcagataaaaatctgcactaggctagagatttaaaatattgctgatttgttcctgctgacaatatttattagattcctcaagatccaaaataaaatgacctaaaagagggtacagtttgttttatccaaattgttattagtttctcaggtcattcagaaacatccatctcttccagtttcttaactccttggcatgtggcttatgctcaggtgtaaagtcaccctttcatcacattcactctgtcttagcttttcgtttcttggcattttgtgttgttaagcatgcggcctcctcattggagcaatactagctaggctgttccactgtctcactgattaggacatggtagcatatatatcaggtcaatcaaatacccttctggtcagaagactagagaggttttcttcatgcttcttgattagatgaatttgaggaaagatctcgtatagaaataattttaattttctcaaaagaaatggtaattttacatgtatatggagaatattttaacataaactattctgattaaaattatagatgtacatatacaagtatagtggtgggaaaatatttttctgcactgtgtgttattgtgtatatttgggagattaacatttccaaacaaccaaagtttaaagcaaaaggtgtcccatttatggccaagtagacttgcatgccaacagaaagacattgtattaaaaccatatgcaattctagccatatttttctactttctcttcatgggtattgcatgatggtatttctaatacaaatactaatatgctttggaaataatggcactcgcaggtctttcatcatattgtatcactgctttatcatattaggctaatacactgcgagagttggtagaacctctccatgccaaatcggatccacttctgttggcactcaacccattggactcacagattgataagctaatgtttagagaatttagatcggagagagtcggtacggcgcagactcaacatcaacctcttgcaagcaactaaaatggcctcgtccttgctgtttataacagaaaacagacttgtaaaaagcttagatcatcaagtgttttggattgggggcctcccaaagggatataagaggggcaggccactcttaagaagaatgcgagctttctacattgggactagcataagatcaaagccaatcaagatggagcacagtaacagaaaactgcggtttctgtgggagaacagaaggggaaagggtcttaactgggaaagggctctgtgtggtaacacctcagttgtgttctcctgacaccaggaaaagagagggatcagcttcaataactagaaaattctggctgtttaatggactctttggtggcctctttaaggcaaagcagagaaagcaaattatgtattaagtgtattttgcatttttaaaacttgacgtgctgtattgtactaaattaagtgtaatctattaaggcaaggtatacacaatttgctttgaaacttactatgtttattctattataaagtgtattcaggtgcaacacagagactgctttcggtgacattaatgaagaaaatttctcatgccaggctttattatagaatcttcagctaaaatcctaactttctccttatttcttggcacttgtatacaagtggtgttgcctcttagggcaggcatgagctattcttttctgtaaaatattttgaatctataggctgtgggtttcatttttgaaaagtattttgtctggatgtctttcaaactagcttcagatattatttaatactatgtaactgggtcccctatggctcaatcaatattgcttatttttcttctgtagtggatgtgaaatttcctttagttggataagatacactgtaataattttaatgctaattaatgatatttcatactgtgcaatgaacagataatttaacactgtattttgaaatgtttttttcttcctgtcaccgcagtgtgtggtattgcataatgtgaatacctgtaaaaatataaattacttaaaaataaaaatatgaccaattggtatcagatcttttcagatagctaaataatttgctaagtatgcctgatagtaaatatctttctaaaaagaagtaatcagtgcttctttctcacaaatggaatttgtgtctgtgaataaaatcacattgatctgcc

SEQ ID NO: 5533 - DNA, 268420 bp, human; identical to SEQ ID NO: 5532

SEQ ID NO: 5534 - DNA, 279833 bp, human
agctctgcgctctgcacggaaccgaccccgtacccatggctctgataatggaaccggtgagcaaatggtctccgagtcaagtagtggactggatgaaaggtaatgcccgctgcggggagggtgaggcggcactggggcgcggggcaccagtgcgaggttaggagggggcgcccgccgcgccagagcccgccaccgcggcttccactggcggatcgtcgtacgcgtcggggcgggggtcctccaggactggcaggggcctggggtccccggtctccttttgtctccagctagaggggcgcggagcggccagagagctagagggcagcgggcgccaccccgttggaggcaggaagtcgggaggcagaataccggcgcatcttgcgtactcccctctccccttactgcccccgggccaggaggacgtggcgacccttatctcccagctcagggtggactcccccaggacctgctcccctggtcgccctttcctggcccctttgttcctgggaaagctgacgccccctcggcggccgcccttgccaggtgccttccccagcgccaactctcccaagcaacttttagcccacataatggggtcaggacgcggccgcccccattcggagcctggcatccccccacacccagatttggctgaggatgcccagggtgggggtatgtgctactttgagggtgaggacatcatgcttcccctgggacagcatccttgctgctgtctctgggctgcctccagcgcatcccctcgcatcctttgccttctctgctttctccctttcaagccagtcgaggttttggacctcacggctttttattaagggctcaacgccagatgtaaggtgatgcgcattcaggtaccttcacatttcttccatcttgaaggttcccccttttgtccctggcgatttataataaccacagttatagacactcaccctcctaatcgcaaacgtgagctttttttctgatccctgggctttcctgtctcactacctccctctgttgtctgagttaaggggcttgtagaggactcccccacccaccaaccccttggatcctcaggcccaactcttccctaagattttgggaattgaagaggggatggatgggatggaatggaataaaggatgcgtggccacacttgggaaatgttagcgctttgctcgaggtcatacctgagcaaactctaggtagatcagtcagggaccaaaggcttattatcgctgaaaatgcccgttcctacgatgaaggagccccttcttgggcttacttaacagtcagactttctaagctccagataatttagaacgaaaggtgaggtgattgggagggattgagagtgacagggagaaactgattttttttgctcattcttttccccagcctttttggccgcttgcttattcttgtggatttttctttattttgctttccttttattcccttacttgcccctttattcctcatttactttgcttttcttttctaatatgtggaaactgctttgtaactgctaagcagtacaaatgtgagtgaattgaattaaacctaatacattatttatcgactgcacccctgtgtgcagtgcattgtgctaaggtgccatgggggatataaagatgactaagacaaagtcctgcagtggctcatctttgctgctgctttttctctttatgtatttgctattgaaattccaatatcttagattcccaccaattatcctcactctccaccttctccgtttctcagtgatggaagaaagagccagagtatatacaggaagcaacaatgcttaaaaccccgttctttgaatttgtctaaaaggttactttagtttgagtctgttgctgaaatattaaaagacaagctatcttggctccatgggagtctgattaccttcatagactacctttcgcaaattcccatgatgcctgtagtgagtgctgcatactcagtctccacctcccaccctcccagttatattcttgcagtttcccctctctccatagtttaggtccactgaagcaagtagaatatatgatgcacctattctgacacacattattagttgtccagtacaccagtcctttaaaaatctttccagcctaaaatgtggcttctttgaagttaggttaacattgttagctgtgatttgaaaattttttttaaatgtaagtcgaataccttgttttcatacctgttggtgacgcattttagagctatttgaaaagatcaattgggtagccaagatagtttgtgtatcgtgtatacatatgactggaagagaatgaatgatataattacctgtatatttcaaatcccagactacttactgctgaaatttccttaatattcatatatatttgatttgagatattatcagaaaatgagattttaaaaaatagttggatgaaacaaacatttcctcaacttgtaacttacactgttaccttaatttttctctctttgcccttttccccaaataaagttaaacaaaggacattttaaaaatatttttcatcctgcagtaatatttaaaagtcaactgctaatttaggctatagctttgagatggctaaacctcatttagtgttgtataatatgtagtgttgtaaaggcagtaccaaagaatgaacaagactgttgaacaactgcaatgtgggagttcttcagaggatgctcctaatgagacagtttcatcatccttagcattaaaagcatatagtatatgctttcagctggtcacaatcataaatagttgtaactctgtttagtaaggtacattctttatgtactttctagggtatttttttcttcactaaacagaaaaagaatcgctaagtgtgtaagaataggaatggccatatatttatgattctagacaatttgtagaagtggtatagaaactcagtcccagagagggaaatgaagggggaaaaaaagctgacaagattattaagctttagtggcatatattcaagattatttatgagggacaatttttacattgcaattttgatgcaatgtataaatggattcattttgattgatcaatttttattaaaatatttgagggagatggaaatataaaatgtatatattgttagtagtaaaaatataaggaaatccttgtattcttttgctcaccaacttcattatttgtaaaatcaaatactcaactaaattttctactgacagtaaaaattggatatgacacagtgtcaatgttatttccagtaagtacatgaactccttatgagtcagtgaaataagtagctatatcccaaattatcctgatagtacttctggctatttggagatatcttatagaccttcaaattaatttttaatattaatcttataaaaatatttttggagaaaatcaaatactcataatttagcatttgaaactgaccttcttcaattggaaattgcatccaatcctcttgtagtttttatattttaaaacataaactattttcaaggtaaatagaggcaaataagttattggaaaaagccataggcagaaaagtaggccaataattgttctaatttttcctccatctgttattctaaaataagttatttctcagctcctacctgttcacttgcagggcctggaaatatttcataatttgcagttatttgagtccccagaccatctctacttttttgcccactgaaatataacaaaaacccctgaatgctttagggcccctgttattaactttattattaattttcctagtccgtgtcacacccagtctttccatttttttttcttacatcttttccaactctgagactcattcaaaatatccacatgactaagttatttttctaggactcagctccctacattacattcttccagtaatctttaatctctctgggtcaaataaaatgattatgacttttcagagttaaccaataggccccattttgcttgtcttctcttaccatctctgtgatttagctccagccacttttgtattattatgattcttaaaataatctaaatttttaagatagccttttctcaacccattccacaatcaactgctctactctttcctgtttactataaatcatttcttcaagaggcattctctgacttctaatttctgtcctgatgactcagccatcttgaggatagaaaataaaatacattcttttaggtataaaaagcaaaaccaatgttttgtatacagtcctgtaatagaggaaaatgtagtgattatataaagtctagtcagtataaaagttaaatgctgtaaaggagaatgtgttggataaggcaaagatgttttgacaggtacaatactctttagtaattcttttttcccgtcataggacccagagctgaggttgaaatttgtctttgttacataaaggaaaatatcaaaattttgagttaaactgtcttgagagagagattggaaataattttctggcaggaactgcaaataagcttaagtgatcaaattgtatcacttccttttgaaaacttagggttttttttcaattgaaaggtgactaaattggcaccaacaattgtctactttggatttgacttttttggggaacaggaattcttgtcattttatgtaaagaagaaatatatcttttccatatgtagaatttcgttcagaagaaatgttatttttcttatagtgttattaacatttgctccttaatgtaacactcatgatttagtgcagattaggaacaaggagtatatttatgtagatatatttgctccatagatattattttctcagtgcttttgcatggagggtgctttaatgggttgttttaaattaattattctctgctttggggaaattagcctctgtaagggatggtagtgacattgacaaacttaggcaaagacagagagaggtgccaactagcacatgtagtaattttttaaaggctgtatatgagcaccattggaaagagaagatgataattttattgaatcaggaagggatctgtgaggagggtggggttctagcaactatttaagctacttatttaattaaggcataatctaagagggatgtatactaaatgtagcggcacagcaagaaactctagagttgaaatggggttattaactaaaggggggttgtatataggtttgtctggatgaaggagagaggtgggcagtagagggaaagtgagggaggagcatgagtaggtggcacaaaagtacaagaacaaatctgcatttcacaaagacaataaaactctcatcatgtcctgagtttaaataaatgccacattataaaactttagctgccaaaaataagcccacaaagaatgtgtattgaattggtacagctgtttcaaatctgtttttcaggaatgatttgaaaataatgttaaattattttgaagacaaatcattaacatgttgttagatatttcgaattttactgaaccaagttcttatatgaagaatggaaatagacttttaagtattaatactgttcttaaagcaatgataaattatcatttttatttataacagagcaaccctagattagggctcaatttgttctttttttttttttttttttttgagatagagtcttgctctttcacccaggctggagtgcagtggcacaatctcagctcactgcaacctccgcctcctgggttcaagtgattctcatgcctcaacctctcaagtagctgggattacaggcacccaccaccacccctggctaatttttgtattttttagtagacacgggatttcaccatgttggccaagctggtcttgaactcctgacctcaagtgatccacctgcctcggcctcctaaagtgttgggattacaggcgtgagccactgcacccagcctcaatttgttcttaatgacttttagctttctatgtgtcttccctgcagtacctcacacataagggttattgtgaagaataaagttattagcttctaaaaagagtactaaaagagtggatcatctgtactaattttaaaaaaggttgggggaagggagtataaagtaatttgaaaaaaattgagtctaaaagttttaattgttcatggctttttattgtttagtgtctgattaaaaacagcaagtatagtcttcaatgtggaatcattgtgttgaattacattcggtgagggaattcacagttttcatgtatagcataggcctgtattcctcaaaatggtatatttttgtggttgtggaagccaaatgatcaaaagaagccaaagagttgtgttttttttgttttttgctaagctttttaaaacattatattaaaacaaacatggatattatattcatgatgtagaaagcaaaattggcattatttcaaagatgagaccagagacttaacaggaattttaggcttgcaacaggctgtttaaagctgtattctccagacctcccagggctgagtacactcttttgagcaattacagatgcatcagtggaaaagttggagaagtggtggttgagtttaaaaaaggtaaaattaatgtactctgtttccctttttttcctattaccacaaggcacaaaatatgaccattttcagtcgaggtcatgataattgtagcatcttaattttgtttatttgtttgatccatacacctgcagtcaggatgaattccttgaaaataaatctcatccgatctcattctctcacttcttaccctcatcagtttaaaacaatttaatgacttctcattgtttttaggataaaggtcaaagtccttaacatggcctataagactcttgaaggtttggccattgcctatgaggtaagcgtcatgcccagcaccaagtatgcaggctgcctcaccgtccttcctgtttgcctaccactggacatttgcacttaatatgttccctatccctcttcacctagttaagtcttactcacccttcacgtcttaggctttttctcatccaccttaggaaagcctttccagatttgttaaatcacatcaaatcctcagttatatgctgtcctagtaccatgtatatctcctgtgtcccattcaccagttttatttttatattaatttggatggttatttgatatccaactcccccactagatgagtgcagggaccccatctatttcttgtaccagtgtgtaaaaaagtatctggtatgaaataggcacttagaaaatatttgttgagagaaggaataaattaatttattcacagattactggtctgtcagcaaatctgctttcctaaatgacaatgcacgtaaagtcccttataatgctctaatggatacttcagtgccaacttgtatattgtgtgccagaatacagtagaagtagggttgctttatccatttctcatagttgtagtgctctagccaattcaaagatacgaatcatggtttaaacttattttgttacaaaatattaataatttcaggaaattaataacactttggtgtttatgccatattataaatagtataaatattacttactaatatcacttagtaagacaacatgataagcaaatacttattaaaacattaaaacacactccttctcctaagcatttatttcccttcattcaaattttctaattgtttcttcatttgggtattttttaaagaactctatatatcttagaatgcatgatggagtgaaattgatcagatgtcttaattttgtcctcataaaaataaaaacaaaaagctcatataaaaaattaaaatgcattattctgttgtgaggatatcctttatttgttaattgggacgataaaatggaaaaacaacccttgggcttaatgaaaccattatcttatttattatatttagtgttcaatttgcatttttattaataggaatacaattaaggtatttaaaggtgcatcttaaatcagcattttcttgtgtaatttttcaccgttccctctgattttgaaaaaaagaaaactttaaaaactagatgtaagtttatcattactaatttttgaagggcacttgttaagaacatacgtacagaattattgcaaagcatagtttgctaaatacaggtgcctcaagtggattttctatgaattacatgctgctagataatcactagtaggcaacttaccaaaatttttctaataaagcctgcctcctcccaatttagaatcattaaaatacaaatcagagtaagtgaaattgtaaagatcttaataggcatgccagtttgttaactctttataaaacaccatcaggcttaaatgctctagctagtactgcaaaacaatggattgcaattgtgccctgatttgacttgcaaacaactattctacaagatggaatttttaaattttaaagatgtatttaatttattgtttgattttaatttaaatcacaatcattaattctaatggaagttttcattatcttactcttgcaatttcaggaaaaaagagtttgttgctatttgcataaatgcattgaactttaaattttactaaagtgcagtaataactgttttagctctctttgttcatctgttgactattttaccacaacataaaattgtttgaaaaatcaaaatttatttagtaaaccaaaacttgcactgacaccaatatatgatagtttgtcatgataaaaatattgttacataactaatatcaagtatagcatacatgactcttatgtgtttacttggcattaatgttcttagaaattaagtaggttggatggtctttagatacagtggtagataagaagaaacctcattaaattagttgcgtttttaaatgttgctcaatatctttttttttttttggtgtttgtttgaactttttattttgttccagatacatctgctatttttaaaacaggcttgcaacatgttttcttaagtaatagctagaacaaatcgatggaagcctggcttagatcctagattttccttttttcaacttatttaccaaagattgtaaaagaatctattttctagtaacttgttagttatacttagcaatgtaatttattagtaaaaacctttaacaatgctggcattaaataatacagctgaatgattaatgttaacactggctgaatttttgttttaattttggtgtgttttttatgtgtatataggaacttattttgtatattttttcagaaaattgatattttaattttgtgaaaatcatttatattttggttttcaaaacaggccattgggatattaaatacatataacagagaaagtgtagagattttgctcatgatgctcaaaacagacatatagtagtccagtggctagttttcctcctggcctgctggaacttacgtagaaaccaagtttgatgtggtatagagctagcatgatatggcagggctaggtgctctttccccatttcctattatattggtgtcaggatgagctttgtggcagtctctgttggcactaatgttacattaaatcaaaggaacaaggcttccttatccagaagcctgctctgttgccttctagctgtcagaccagagactttcagtttgatgttgaattgacacacacagagtagttagttctgtgaaatatttgggttagatgatttttctttccagtggccctagacataatgctttgagtttatttatggtaaaaacctgttaattgagattctgtttatttgggatttgtgataatttcactgtgctcctattgaagattactgttaatatgtgaaggaaaggtttgctgatcaatctaataatgcaaacaagattggaaagaaattgtttgacctgggagaatacaatgtttttgtactatactttgccaggagccacttacatactgaaaatatgctagttagaaaggagctgtatttttacttagaatttctgtatacttagaattatcagtctttattttttggagtattttccaaacattatttaatatagcttggttcttctcattcacccaaattggaaaggtcatgtacttcacattatattattgctagtaatctttaaaagtgagataagggagagttattaacacctttttataggtaaagtacagagaagttaagcagctcaacagagattgtacagctgttcagtgaaattaggtttgacgtcaacttttctcctactggattggatttacaatttagtgggcaaaggacacaattcagataggtacacaatggttttcagaattgaccttttaaaatttttttctgaattttctaccctttaaaaattggcataatatgtaatatagtacaggtaagagcactttggaatcatgatacctgggtttgtatcctgactttatcacttcttagcttgtgtgatcttagggagagtttaagtaattttcccaagttttctcctttttataaaatggggatgctggtattacctacaattaccaatctaaaagatgtttctacattttgccacatttttctgttgtggtatacttaaaacaatgccttgtatatagtaagcacatataaatgtcaacttttttaaaggaagagattatattctgttggcaatattcagaggcagaactaataatagattatatttattaagtgcttactacatactgtgtcctgtgctaggtgctttccctacattacatttaatgcctgtcttagccctgaaaggttggacttaatccctattttacagatgaaggaactttggcttagagagatttttacttagaaatgttgaatgacttgtcctatatacctgtatatttattaagcaggtgtttgttttaagtattgatttctgattggttccaaaatacctaatatttccaccttgcttttctagcagaggtagatgtgacgtgagaggaatcctggaaatacttttcaaagatgtgtatgtcctctccatcagacctaccttctctagtatctggtaaggtgggctatagtttttgtgtcctttgggcttctagtgagatgtgcgtgtgcgcgtgtgtatgcacgatgagttgtttctacttctcaggatagggctttcattagtgacaaagatgccacatattactgtagtcttggtgacagcttttgtattttgaagtgacccctagagtttgatgttcccctctgctgagtctggatgtaggcaaaaaaaaaaaaaaaaaaaaaaaagcctaccctgagcactactgccaagaacccagtgctgagatgttttgttatcaaaggattgttaatatgtggtgcctgataatagacattcataagtatatcacattttaccaaaaataatgatgttttgttaagatttactcagcagtggttagccttgctacctgcatttcattagtgtttctttgaacagcagacattttttggtgcgttcctatggatccgaaacccttatatacctacaaaatgttaattcatctcctcaaattgttttgtttggagacatttatcatagaccaaattgtgatatgataggaaagtttagtgaatcacgaaagcaattttaatgctagaggaaatttaatcataattagttaaaaaactattgtgaaataaatgcaaaatatggagtggtcaagttgaattagagatatttgaccaatggagtgcttgtaaaatggtaatgaaaggcacaattccatctacattatatttgaaagtgatacacataattttgtatatgttttaaaaatatgtattctagtatatatgtggaaacttaagtaggatttgttcaaagttatgcaaacatgatattttctgtttctccttgctttcttttaatagaaagagttaaggtgagtttgcttcagactggaagtgttaaaataagtgaaaataacttaaattgttctttacttgtggagagaatggtttgaagtttctcactttttataaaagctattacaatacccaggacaatagaaccttaaaaaaaattgtgaactgtggtagattaccaaccactttgaagttaccttagtcttgtctctctgactctgtaaagcacctttttctcctaaattgctcattatcctttaaaattcatatgaattaaaattaattttgtttggggatgtttttgagaatttcatcactttctttgaaataattgttgacaccttgttttaaaaaacaatctggtttaaatatggtaatactgtgaatctccatctacattaattttaagatgtatctgatttaatgtttaaaggcagtggtttcttatgtttcagattttcaaatgaagctgcttattcttaaacatatgcatactggaaactaatgcatgcacatagaaaataaatacagcagcgggctggatgtggtgtctcatgcctgtaattctagcactttgagaggttgaggtgggcaaatcacttgagctcaggaggtcgagatcagcctgggcaacatgacgaaactctgtctctacagaaaatacaaaaattagccaggcatggtggggcacgcctttagtcccagctactcaggtggcagaggtgggaggatcaccagaaccaggaaggtcgaggctgcagtgggctgtggtcgcgccactgtactccagcctgggtgatagagtgagaccttgtctccaaaaagaaaaagaaaagaaaagaaatacagcagaatagctgaggaactataacactattatcacgccaccgtccattcattccttaatatcaatatctgtatgtacaaatttctagtttcataaatgtcaaacacttttttttcttcaatcagaacccaaatcaggtgcacacattgtagtctagctcattcttttttcctatgtcaatctttttggatgttttacataacagatgttatgtaatatctcctgaaataaaattcagataatataacctacctagtcacataatttttttaaaactcactaaaatgcccttattgtaataaaaagaaaaacacataataaaataatatgggtttctatatgtacatactcagtatgactatacaagaagaaaataattgatatttttcctacttttttttttgtttgagatggagtctcgctctgtcgcccaggctgaagtgcagtggtgtgatctcggctcactgcaagctccgcctcccgggttcacgccattcttctgcctcagcctctcgagtagctgggactacaggcgcccgccatcacgcccggctaattttttgtatttttagtgtacacaaggtttcactgtgttagccaggatggtctcgatctcctgacctcgtgatccgcccacctcagcctcccaaagtgctgggattacaggtatgagccaccgcgccaggcctatttttccctacttttaatgaacatatctggatttaaaagaagtgttaaaatcagaagttgttccatagagtgtacaagagaaaatggaagaacagatgaactaatagacagtgaagtaaaaacaaatattaggagaaatgttaatggaccagactcatttgatgagccattctagtaattcctattgaacatttgaaagtcatgagtgaaggaaacagctttttggagaatgttatattctagggctgggatagggaatatgcgagaagagcctggagcatcctgtagtgccataaagtaaggaagtgttcaaaaaacacaatgatgagggcatgtaaaagactgaaaagccaatctgaaagagcttccaatagctaaagctggaacaatttgaacaataaagtattacagtattggattataacccaacatataaaataaatatattcatggatccatcctgatagatagaaatgtctagataagtagagaaatggaggagaagagacaaatcatccatgtagagaattacaaatcatttatatacatactccctaactcccaccacaaagaggtggcacttaaatccccactccttgattgtaggttgcatttagtgacttgtttccagagagtagagtatgaaaaaggggaaacatacaactttatagtggagaaacctggcagttgctaccttggccaagtgatcaaggttaacatcatcagtgataagtcatgttgatagcatgtacccatgatacgatgtgatatgatgtgatgtgatatgattgatatgatatgatgagaatggttctttatctctgtggtctttctttactccccacaaacccataaccccattctaaccatgagaaaaacgtaagaaaagcccacatttaaggacatttttcagaataccgaaccaatactccacaaaactgtcaaggtcaccaataacaaggaaaatgtgagaaacttaaaaaccagaaaaggctaaggagacatgataattagttatattatggcattctagataggatcttggaatggaaaagtacgttaggaaaaataatgaaatccaaataaagtgtggagtttagtttattattagcaatataacaaggttggttccttaatgtagtgaatgtacatagtaatgtgagatattaataataggagaatatgggtgaagagtatacaggaactctttatactattttttgcaacttttctgtagatgtaaaactattctgaaatttttaaaaagttgttcaaataaaaaagttacagtatttttcaaatttggtaataccaaaagataagctatgtctcatatatgaatagttttgttttgcctctctggaagtattaataatgaagtctttcaaataaaaaagggcacttgggatatagagttgttcttcactatgtgggattgttccatccatggatctagcaatcattcagtaacctaatcattgtgataacccagtactactcataattctcaaaatgctcccaggaaacaatattggccctggcctggcatcaggatccctggccttaccacttttcttttttgtaaaccttatagttttccacgtgtgaacattttttaaattttatgaatacatattgttgtgatttgaaaaataattttattgaatgaatgttatactttgttttcattctactaaatttaatcttttatttgattagcattttttaccttttgctaatcaggaaatatgtttaagaaaaggagattaaatgtacatggataggatggagaccaccaaaagttagctccatcttctcattttaccttaatgctaaacaatttgcaattaaactctcagacagaagagtgtgctattctaaacattgttaacaaagcttgactcccagtgttccttctaattgtagtttctgtttcctgtaggcaatttgtgtgggaatgttaagcaaggcatgataatttttaagtaaataaatcttgtggtttataattgataatcagctgtatatataaatgtgtgtataaatatgcacacacatttacttagggcagatatttagttacctagggcagtatattagtctgttcttgcattactggcataaagacctacccgagactgggtaatttataatgaaaagaggtttaattggctcacagttccacaggctgtacaggaaacatggctggggaaacctcagaaaactttcaatcatggcggaaggtgaaggggaagcaggcacgtcttacatggctagagaaggaggaagagagcaaagggaaaggtgccacacactttgaaacaaccaggtctcatgagcactcactcactatcacgagaacagcaagggggaaatccacccccatgagccaatcacctcccaccagggccctcctccaacattggggattacaattcgacctgagttttgggtggggccacaaatccaaaccatatcattctgccccggcctctcccaaatctcatgtccttctcacattgcaaaatacaatcatcccttctcaacagcctgccaagtcttaacttatttcagcattaacttaaaagtctacagtccaaagtctcatctgagacaaggcaagtttcttccatctatgacactgtaaaatcaaaaccaagttaggtacctccaagatacaatggggttacaggcattgggtaaatacacccattccaaaagggagaaatcagccaaaagaaaggggctacaggaccatgcaattctgaaacccagcagggcggtcattaaatcttatagctccgtaattacctcccttgactccatgtctcacatccaggccacactgatgcaaggggtgggttcccaaggccatgggcagctctggccctgtgtctttgaagggtacaacccccttggtggctatcccaggctggcactgagtgcctacgtcttttccaggtacatggtgcaagctgttggtagatctgccattccgcagtctggaagatggtggtcctcttctcacagctccactaggcagtgccccagtggggactctgtgtgtgggccccacatttcccccccacattgccctagtagaggtcatccatgaggtctcctcccctgcagtagacttgtgcctggacatccatacatttccatagatcctctgaaatctaggcagaggctcccaagcctcaactcttaccctctatgcacccgcaggcttaacaacatgtggaagctgccaaggtttacagcttgtaccctctggatcagcagcctaaggtgtatctggggtccttttagccgcagctggagctggagtggctggggacacagaaagcagtgtcctgaggttgtacagggcagccaggctctgggcccagcctacaaaaaccattcttcccttctaggcctctgggcctctgacacgaggggctgctatgaaagtttctgaaatgcctttgaggccttttcctcattgtcttggctattaactttcagctcctctttacttatgcagatgtctacagctatcttgaattccttcccagaaaatgggtttttcttttgtaccagatagtcagactgcagatttctgaacttttatgctctgcttcccttttaaatataagttccagtttcataccatctctttggtcatgcatatgaccatacgctattagaagctaccaggccacttcttgaatgctttgctgcttagaaatttcttctgccagataccctaaatcatcactctgaagttcaaagttccacagatcccttgagcaggggcataatgctgccagtctccttggtaaagcattgcaagagtgacctttactgcagttcccaataatttcctcatttccatatgaggttacctcagcctggacttgactgtccatatcactatcagcattttggttacaatcattcaacaagtctctaagaagtccaaactttccctcatcttcctgtcttcttctgagccctccagactgttccaacctctgcccattaccaagttccaaaactgcatccacatttttaggtatctttatggcaatgccccactcctacataccaattttttgtgttagtccgttctcacgttgctagtaaagaactacctgagactgggtaatatataaggaaaagaggtttaattggctcacagttccacaggctgtacaggaagcattgctggggaggcctcgcgaaactttcaatcatggcagaaggcaaaggagaagcaggcatgccttacgtggttggagaaggaggaagagagcaaaggggaagatgccacatacttttaaacattcaggtcttgtgagtattcactcactatcacaagaacagcaagggggaaatctgcctccatgatgcagtcacctcccaccaggcccctcctccaacactggggattacagttcaacatgagatttgggtggggacagaaatccaaaccataccaagcagttttgctgaaatcgaatataactcaaagaccttttctgattgtttttaatcaaggaagtcaatgcttttcttcttgtcattaaatgtggtaccttattttcatcttataatgagtccgtgtagtgcatttagtagatgagtttgggttatgaggggttgtaatttaagacctcctctgttcacatctccaagaaattacattaagtttcaaaactttatacttgcccttaattcttgtgcctttctgattaagatcttccttgttttttagtttaatggtgtgaaaattctaaaaagctcagtctttggtaatcagtagataaagaaactgacagaaaacttaatgcattaacctgatacttcttttctttccacaaaaaattgaaatgttataattgtcacaatttcaacttacttgattctttgttattaatacctctctgtaaaaatgtgaagttctgttgacattgttgaggtgaatgtcttaaaagtgttgccctgatttgctgccaaatgtctttttctgatttatgctctgtgagtaccagcctagctatgcattaatgtgctctctgtgaaatgcttctgctttttgtacaaactattcttaagctatgctcacgggaatgaaggacaggttgttttatttcaataaggtaagaatgctttacatttaaagaaagcttcaaaaaacaacctgtgtcaattatacattaaatatcaggggtttgaaaccagttttgaatatgtgaccagaaaggatggtttgacttttcaaaagaatttccaatatcttaaaactttagaatttatctcgggttaggtgggcaatgtttagactaagttgtttcaatgctttccaataatacttttcataaaatttcacagatttagggtggctagctattgcagtaatacagtcttataataattaacgacagaatgttagaagcaaattgtgtgatttgcatgacttatgaaatgcagatggtgagaagtagacttggaagctttttcagggtgcagatggacacaagttcttcagtgaagttaattaaaagtaatcattgtatagtaaccactgtcttgtaggctgctaagaaattagtattctactttcccaaatgaaaatgccagatgatgcctttccaggctgtgggaaatatctttatcacctgtagtcatgtcaaaagacgcattcctcttcccctttcttcctccatctctagatttcatacagatgaataaaattaaagggacaaatactagtaggaagcactgtatatagaagacaatacaaattatctgtagtactaagttgggattggaggttgtggtccattccacatcctgtcctgtatttgtatgtgtgtttaattcatgtgtttacttctcaaaccctttattttaaaatggagataattaaaatgtgttttatagtgaatagctgaggaataattaatatatagtccaggcagaaatggaataacattctgacattggcaaaaaagaatttattactgtacaggatttaaaatgatcttaatggaaaagaattttttaagtattccagtttagaaataaattactagatatagctcacatgtgtttgccttatgatatggcatgaaaataagattatactgatttaaaaatgcatctgggttatagatttcaggtggctggctttgttttgggaactctttcccttttactaacttctgtcatgtagccacttctttttctaacagctgtattggagtgtttctcttcgagtcaatgtttttacttatttgagtcaaaagactacttaactaattttgcctagttattagaatggtatattccatttttcctgccagggaactcaatacaaaggtcctaaagcattgttgttgatgggtccaccaaacctggctaagtcctgaatcagtatagacctcatctcagtagtaaaccgtgtatatcacagtcccctagtacttctcagcattattttatcacaaagtttatgattatttaaattttatttctcaaatcttgtcagaagattggaatgtaagagttttattataaaaggtttattattatacatagtgatcaaaattattattaaacactgaatctgtgcaatgaaaatgataggtacttagcactagagctccatttaagtgacagaaatgtattgacttttcataggaaaaacaggcaattgtaagaaacaaatgaaccaattcgtttcagcttggatcactgaaaacaagagagaatcattggcaaaacaatgccttctcattcatgtgtcacaagtggtacttggattgaggacaattgagaagcattaagactgcaaattagttcccaagttgtgtagaatagttgtttgaaagtgtactttcccaaagctcctatgccagcttttaattttcttattaccagcagttttgtttttcttaggttttacattttggtctgcatttgtgttttccttataaaaatgctctatatatccaactagtacatcttgtgtaaatgatgtcaactcatatataagacttcattttgaggaattttaaaaatacacaaatttattaagagctttcttttaatccgtataatagtgtaacaatgttgaccttaaagcttttcagaaatattcaccatgattttgttattactacttcttcaatctttttgatattgacatgtttctaaacgacagtggatagtaagatgtcagattttatactttcattcaaactttgaagaccatttggattttttgggatgatcggctctgagccattcataactcatttgttaaaaacacataagtcttcgagtaaatgaatgccttgaaaaaaaaaagagatcatgtggttgagacagctttacttctgtcagggttacctatggtagggcaaattatttgggtttctggttttctttcctataaaagaaagttggatgatatgatcttaaaagctgtaagatttggtgattataagcttttaaattcatgttcatacttggtttataagtgatgaatgataaacattcttgattttctttacatctacttttatgaccaccagtgacagttgggccctctgaatttttcagtttaagtttttttctacccagtaattaaatgccaaacacgaaactgtatgtgctttacacaaagatttgctatgtaacaaaagtggaagatgtattttttatgttttaggtggatttgaatgcccacagatctaggccaccaatgccagtttacctttacagattctgtttggcaaattcctaagacattaggttacaaatctttctcctttctcttttttctttcttttttcctttttctatattctttcaccactgaaaacttttaacagttacaggttagcaagcatatcattgagcaaatgccctccagcctcttggagagtcttaactattcacactgtcttctctgcctgccccttggtaatatacaaaaagtttcaggtggctgaagccctaatatattaaaaacaaaaatttgaattctaaatacacctgtaagagcaaggaaaacataaattagaatatgtggtatatgtaaattgatatggagtatctgaaaaaaacagtactttttgttcttggtggtcatatttaaatcatacttttaaaatcaaaagtctgtgtaatatgatagttctgtaagttatatctagatgtctgtgaatgcatcaaacagatttttttaatgcatggagtacaagtacaacctttaagttcttagtgaaatttatgcctatttttatcaaactttaacatgtatggttttattatatttaatgggcaaatttgaagcacaaactcaaatacagttcttgtgtccgttattgaaacacatcatcatttaaaacagtttgtaacattttcttttataaaagaacatgctctatacactgacactcttgttctctgcacaatctatgagatgaattgatagctagaatgagaacaaacttttagaaatctcttggccctatgccctcatgttacttgtaagcatctgagctcggagaggttaaatgacttctctaaattcatgtatctttctagtagcaaaattagtatggcaaataactcagtatgaaagctcagaaatagtatgttgcatagatcttttcattgtgaggacatcctctattagaaacaagagaatgagttcttttgatcactggtgtcaaagttagaacacgtctttattaacacatgcaacaaacctacttcatagaataatcccctcattagaaatgtttgttttagatttcattttatcataactgaatgtaagattctgaaatgccaaaccccatttatagttaaaatgctattaactgctagaaaatcttctcctgatggtcttctaatctctgtgggctatgactcaatgattttaaatctcattttctaaagctttgcagattgttaacgcagtccagtgcaacaggattaaacacaaatctgaacacaccgtactttttgaggtccgtttagagctgaataagtggtttgctgtgctgaataatttattgtaattcactttaataattttccattttaattatgagcaatatacatgcacctaaaactcttaagtgtgaattttttgacactttaacccttagctgtctatattatttaagtaacctcattcacactactggaattaatatattagaataaattggtcccttgtgttttataatacaagtagctgtctatgatacaccaaaaaagtacatttgataccacatgttctcactcatatgtgggagctaaaaaaattgaatacatttaagtagtgagtagaattgtggttactagaggatgggaaggggagtggggatggggaattgggataggggtttgggagaggttggttaatggatacaaaattacagtcagatgggaggaataagttctagttttctgtagtactgtagggtaactatagttaacaataatttatgttttcaaatagctagaagagaggattttgaatggtcccaacacaaagaaatgataaacgtttaaggtgataaatatgctaattaccctgatttgatcattacattgtatacacatatcgaaatatcactctgtagcccataaatatgcacaattattacatgtcaatttaaaaagtgcattttgaaagatcaaggctgctgaattattttaaaatttattcagaaagcttattgattttgatgtcctccttttgtacctattgtatatattacttacttctatatagtagactttatatcatttaaactgttctgatttctgtctctttccaagattccgacatcctagtgttataaagcctcaacaattggaatctcaggttttacaaaaatatttgtttaaaatgagagtaattatagcagtgtgatatctgcatttatcagtgctttgataaggtgtgtacattgtatgcatcatagtgaaatttctggtaattattttaataactaaaagtatttaacaaaatggaaacaaatacattaatagatttttcaaatttaatatttatataggtctcttgtactatgtgtgctgtcaagtattcaataagtgaaaatataaaatactttttttcaccactataatgtcattgtatgatttttattctacatatttctctaatggtacttgctatcttttacaaactacttctgttgcatgttaatttttaggtattgtatttttcaagatttatcatcttttaaggaaggcaaaaacatgtaacttaatcacttgaaagtgaactgtgtcattatgcacattttctgatagctgctgtcaaagataaaataacacttcctgccaccataagaagtgtggtcacctcaggacagcactgagtcatacatctggggccagtaggaaaagttagcatcattggcagccgcctgggctcttcatgttccatggaaaatggcacactggcgcatagtgtaacttaaatatttctcaaatgcctaactccttggaaaaattaatgttaagtagtataaaaactgaaatctatgactttatattgaaccagcggttttgagttcttaatttaattatgcttgttccacccatttgtaattctgatttagtttaactaaatttaaattataacttgatatgttaaaatgaaagcaccttgtatagtaaagaacttaagaattgagtcgttactgtatttttttttttaatgcgttaaccactctcaacctaggtagcactggaatatgacccttaatgttttttcctgtctttgtaagatactgctgttaaaatttaacttagatctctgctggacttggaatctatatgtatatctaaagtatttatgcaattatacagaccagtaatacaatattagaaaacttggttgattacccttcataaataccagtagaatttggaagtacagaaactgcccacctccatccagtcaaataaataacctgaaagcataaacgctgtttagaagtgttttcttaatatgacttcaacatacttaaaataagtacctataaaaaacaaaatctttaatccaatggctactttctgagtatatattatcaggttataccttataggtattttttatatggaagtaacttgcatatccttcaaatgaaaggaaatttattttacagtcagtagtccctctatctttgtagtcttacttgaaacacatagtttactaattataacagtgctaattctgtatgtttgggtaatatttttatttgtatgtgagttagttttttaatagtaaaataaaacatgttgctacgtacttagatgttttaaaaattttctctaaacgtttaatccattataaaaacctcttaggatagtgcagttattcttttcattaggggatcagaataaccccattctaagttttgtcagaatctttaagtcacattaacttgtacttccaaagaataggcctgtcagggctgtctaccgtgactattgtataactaactaccaccagcatacatcgtcactacattacagtgtggaaaagtgtggcctttgaagccaaatacacctatatttaaatgccagctttgctatttattggctgtatgaattttggtatataataacctctttgagttattcaattttctcatttttaaaatgaagaaataacacctacctcaaagagtactgaggtttaaatgacgtagtctatgtaaaagatgtactaagtcactggcacttagtacattctagttcagtgttggctattattagtaccaccaccacctataaagaagagttgtagtcagggggtgataatatatgcaaagatcatagtagaagctaattattgttacaaccaggcatcatgccagtaacctgcaattaattaatactgtaattgaagttcaatgaaataatgtatttttgaggcattccaatttaatttcactgaaattacataacgaaattagagaaaaataaaagattaccgagaaaatgtatatagaaataaagagcccaagaatgggcagctgaactcaacatggcctgctcatacaaaaatttctgattgtagagtgctttgtcttaatatacttggatgccccattctgatcattaaaaaaagtcatacttctgaaatgtagaactccacataatttccatttggttatacatgatattttattaggacttagcagtatctgaatttctgaagactttaagaatagtatttggcacatgggcacaataaatatttctcaaatgaataaatgaaggaaatcaccctagttaataaaacttgatctcaggcaactgctactactcttaaacttttgtgtcatatgtaaatttaggggcacggccagaaatattgtaggtctccttttttttcctcttcctccttttcaagacctaagaaagatacattttatttaagatcagatatttcctttttatatgtttgtatagattaaacatttctattgaaaactgttctatgaacaaaaagttcataggttgttgcctgaatgaaaaaccaaatcaaaatatatagagaaaatatttttcaatgaataaaatgccttaattctttttggacaaacttgcctaaatttagaggtttcattatgtgtgggctgaaagggcagatgaaagatcacattttaaaattttatgtttcaatgactcctttctttcttacttccttacaagtgttttgcagtgctagaagtatgcaagtagagttttaaaagattttagtcctttttagctttgaagtccaggaatttaaactataccttgttcaagcttgttccttttggccaagatatatctttgctgaacaatgatttgttaaaataggatttctattataagccaggatgtcagcaatactaatagtattagaatgaatgagcttagaaaactgggttaagaaatgatcaggaagaaagtaaggaggttggatagtccactataaataatattaaaatagctgaaaattttctgtaagggtagatagcaaccttttgactttttaatgttatgtggttaaaaaaaatcgtgtattttaaaattggaaataatatgggtttgtatttcttgatcattatctaaatctacaaacatttaaccaaaatggtgatggcatgagctacaaagatctggctctaaaataatttattttggcctttttcaaaaccgaacaaatatcacttctgggttcgtggcacatcatttttcaatggcccatttttcccctttcctttcataattatgtagccctggagtgagagtaggtatgtgtatacatgtgcacctatgtgcctatttcagtagtgtactaagtcctgtctagagtagagaaacctatataacatacagcaatccctatcttttggttaatttcattttaagaatcggtcagagcaaacattttcttttttaccacctttgtttttagatcactgcacagctcattctggaaggaacaaagaaacagaaatagcatagtctttgatcctgggaaacttctaatgtacaataaatgtaaaactagatatttgtacaaacagtaaccattcatgctgtgcctattaagtgtcagccacttttcatactgacttgatttggacattgcagcagcatctctaggttagatgttattaaccaattttaaagatgaaacagattaaaaggacttactagtaaatgacagattcaaaactcagaacccagggtcctctgaatcaatagaccatgcattttctctcaaacatatggtctctcaaattaaataagaacacctacccaatagtgacccttatttttctctagttcatcttacctgagttcaaagaagtgcttttctactgatcaaaaaaggataaaaacagggttgccacatccatacatggttgtgtaggttagcagtacataacctgcacaactctatattgtgtcattggataagtaaggacatagagttgcaaacctagggcaagtaaaaggaatctttataacacccctatttttgtttattcaatagaatttggaaaattagaataaattaatatttttaaatgatttttaaattttcatatttaggtaatgcaaatgtttatgctgaagactatatttgaagttatgaacaacttaggtttaatattttaaaacagtatgtttgtatgattttttcatttttaatctagcaactaatatgaaattttagtggcaaatgagcacatagattatattacaacattttacaaataaaaatacatttttagtatcttagaacgtgaaactagttgacatttaattagctcctatttatgctaaaagagaggataatgctaaaatagtaaataaatatttttatatttatttgacataattttttgtgcctggtttaccgtcttaattatgtttaggacataattcttaaattgatctgttgaatccttaagctcatgattgaggcaaacctattaacaagttcatcaaacctgtgaacaggaagagccaggaaaacactgaaaaactataagggaagattaactttaccagacattaaaatattataaaacctctatcataaaaacagtatggtgctggcccatgcatagacagatataccagtggaatagaatagaaagcctagaactagatcctggcacatatagaaatttactatatgataaaggttgcatctcagatcattggggaaaagatgtttgtccattgccatttggaaagagagacagttaaataccttgcagcttacacaagaatagcctccaagtggattaggtatctaagtgtaaaaattgaagccacaaaagtactaaaaaacccaagatttttacattggtatgtatttctagggaaaatttcacatacaataggaaaattttcttctaacatggcagactctcccccacctcattttgcagatgtgattatttgcaggtaacaggcataggggaaatcagttctccctcagtattcacaatcttgtcaccagctacatgtattctctttaaaacatcactggcaaaattataaatttatgctgttattaccttttaagagtagactcactcctaattaccatgatttgtttatatacattaacaaacagttctaccctaaattttatcatacgaactttagtgtcaattagtctaacttcataaaatatcaaaggtaactccgatttcatgacggtgagatatggaaagtatgttaaattctactgtgactatgactgatgatcgtaaagtttagttatagagagaaaagagttaattggtgattcttcactaaatgtaagtttcagaaggaaaagatcttacataaaatttatagaaacccacaaaagttaactttaaatctatattgaattttaaaataaagcagaaaggatgctcattatgccagcatgtattaaataccttctgtgaactaggttctattctgataatacaaaaatggcatttagtcccatagctggtcttactattaataagtatctgataattaaatgcagaatcttaccctaaataagggttattgactccaatgtgtaagtttctgttctttatacagctgctatgttatatttcatgtataccacatgctacttggcagaacaaagggtaaactacagtacattttaagtaactacttccaaaaaatagcattgtatagcaaacagttccacatgggatctttcattgcagcttctattttcataaatagaaacatgcagcaatatgtagctaagtaaacaaaattgcaagaatagcttaattagttgaaagatccagtgtacctaatcacttacctttcatagaatttgctttgaagaaaaaaaatagcctattctgggatccatagaggagagatgcaagatgcttctataagaaacagtggctcactaaagcctaacttcttaaggagtaaagcaggagaaagggggatgatgagattttatcagaagctagggtttatgtgtgtacagtttttaaaaagtcccctaagtgtcttttaacaggacgatatttaaaatttaatgttctgtctgtcattttttcccttttgtggctactcgttgtatcttgcttgggaagacattttccatccctatattatataaatcttttcctgtatattgtcccaatatattcatttcttaaaacctttagttagctttttattatgtaatttaaaaaaatgtgcagtatattctggccaggcatggtggctcacacctgtaaccctagcactttgggaggctgaggcgggcggatcatttgaagtcaggagtttgagaccagcctggccaaaatggtgaaaccctgtctctactgaaaatacaaaaactagtcgggcatggtgatgcgtgtctgtaatcccagctgcttgggaggctgaggcaggagaatctccttaagccgggagtcagaggttggagtgagccaagagtgtgccactgtactccagcctgggaaacaagagcaaaactctgtctcaaaaaaaaaaaaaaaaaaaaaaagtacaatataaagtagaggatctgacattacttttttcccagatggagagccaggcgttctaacacaacttatggggtaattttcccctcacttatttgaaatgctaactttataaaaaatcaaaatgataaacctcaattatgtaaactaaaatacaaatgcataggtctgtttctggattcttcctttttggatatatttatccattttctatttcattggaattttgaattattgttactttatagaatgtttgctatctgaatggcaagtttcctcacccccatgttttactttttcaaatatttcttgattactgcccatttttcctttcatgtggaatttaggttcagtttgtcaaggctcacacaaaaataatctcattaggatcttgactaggatttcattgaatttataggttaatttagagaaaattaatatccatatactattgggcattcttatccaggaatgtgctatactttcttacttatttggatcttcttttatatccttcagtggaatttgatagctttttaaaaaataaatgtcatctacatttctctttaggtttattcctagtttattggttttttacctattgtgaatagaatttttttcattacattttctaattggctttgctgagtatggggaagttattgaatactgctcttgtatttgactaccttaataaacttgcttattgttctgtgtttttcagttgattttcttggtaaattttctttggttgattttcttggtatttctaagtaaataatattatgcatatgttgatagttttttatcatctaatatccataattctttttcttccctgtctgcgtttgctaggaccactgctcaatgttgaatattcttgatctttagttagtaagaatgctgcttgagtttcactattatattgattatgatgattttgaattgttctaaatgtgctctgcatttgacaaggtctggttaattgatatattaactttcaaatttgtaattaagttttataattaaaaataaatatatttatataaaatcctaacggttcagaaaagttagttttaggaaatgatcattcatgattcctgaggcttaagggtttagcttgctgtgtagattctacatagcagagtagcgtgtagattctacatagcagagtagcatatagactctacagagcaggcccagggtccccagcccttgggctatgaaactgtactggttcatggcctgttaggaaaatgggcggcacagcaggaggtgtgtggctgatgaacgagcactacagtctgagttctgcctcctatcagatgaccggtgccattttagattctcataggaatgcacactgtgttgtgcactgagcatgtgagggatctaggttgtgcacttcttatgagaatataatgcctgatgatctgaggtggaacagtttcatcctgaaaccatccccccattgcccacagaaaaagtatcttccacaaagccggtccctggggccaaaaaggttggggactactgatgtagaggatgagttttcatcttttatttgaacttggtgacttagtttaccaagtaacttgctttcagatcttgtaataaaaatgtagttttagccataaaacatctaattctgttttgagctggtagcagtttatatatatatgtactgatgatatgattaacatttttattgaactgctcaggagtctaactatgtatctccattatttagaaattttctgaaaactgtttcatgcattcctttggaaattcataaagtaagcttctgagaataaagaaattgagagatatgaccactggaccactcctagctgggccaaaaagtattccataaagtttatgatctcccctctccattcctttctgtcaagatcagaagaggtaggagtaggggagtcaatatcatgtctctttagtttgtagaaatcatgatttgaaatacaagtttgtaattttcttgaggtcttctgaatattaatcctgttgccaaatcacagatcactttccctgtacatatttaaaggaaatatttttatttcgttagctaatgtaagtcctgttttttaaaaaacgaaagttgttctttatgctgtcttctttttttcttaacaattaaaccatgaaacaaccataagttgaaaagtttcattgattctgctcctcattgtaacagttggtgatttggtggcattagtaggtcatagtcatagagtaacagtactcttctccaatttgacagactaggttaaggcttttggttttggaatatagattagaactatattatttctaaaataaatcttaatgctgtaagatgtttggaagcaaatataaaactgtagttaatgttgcactcaggaattattagaaggttgaagtgaaggacaaaagaaataaattttattacagaaaacatgtctcctaattaagtattcattaactgcccaaagttgaacttgttaacctcaaggttggaatatactctatgtgttggagaatagatgccatagtagaacctttggtagttaagacagatgtacctgggctatatttcttccagagaatactagtttctcaagatcagctattctgtttcctatgctatgctttttattattctctagtttctttttctttttctattgtgttctcacaagattatcaagaacccctcaccccctcctattcaagcagaaattttggttgtttttccctccttcttggcaagatttgggattgtcatgaaaagtaatgaaatcagctcttttatatataaaattttccatggatgacatgactcagttttgaatagaaatgcaaggttccattttgaattctttaccttttttggattatagcactgctaggtcaagatcagagcgctttgttcataagtaaagtgtataaaacgtaacaggaacttaaagtttcctttatcattattgaatgaatcacacacttcttaaatttttaatctgtggtgctataaccaaaagaacatgtttcctgggaggctgctgacaataaaaagtaattgtagattttcttatgttgttacatattttagtatatttcttattttcttttttaaaataaaaagttcttattcactctaggatccttagaaattttttccatttctagaaaaatatcttgaattcagtagcctgctgtttaaagttatcatgagtagtgaactgttgcctttgggaaaggagcattttgatccaactatgcattttaaatagaaagataatattcatctttcccatatacattaatttagaaatgtctaccaatattttctatacctttcacaatgattatttgcaattcttatcaacattagcttttactttttatatttataatatttgcaatatatagtgcaggaaattcccattaacctgtggctactcaggatgactctcactgagttgttggtttctttcacaggttgatttacagctgtcttgagtataattctgtgtagcaggcaatggtagtgtatttatatgtatacagatcttgcatccatcaggttcttctcattgaaacacaccagcggagagcttactaaaagattgtttgcacagctgctttcaggcagtgaccaaaatttcctaggaaagtgagtgaaaatacacttgttgagccaagctcagaagtttcttggatagtgctttacataatataaagtcattacatgtgttggatctttgcccttatctaacctcccccaacctccactccactccactccacgttcttttttgtcttgcttagtctcctttccctaggagaagagcttttgtttacccttttatgtcttgtgaagtcactaaaaaagatttgtcttctcatatgacatcagtatctaaggaccttcaattacatatcatgttagtttttttttaattctgagacctaagtgaagatgatgtccatatatttttgtcctcttatagactcctatctatgaaactaggtttttcagcagtaatgtaatcacaggagaatcgtaagaacattaagctcctttaactgttgggttgccaacaatatgaatgtggtgttaaatcatgtcttggactttacaaatatcatctaaaagttagttcttaaattcctggcaaggaatttacactgtgctaagaaacagatgttatggagattaatttgtgactggagaagaaatgtctctgtggtaagagatgagtacaggttctgggcaatccatttgacttttaaatgtaagaatggaattccaaacacttaacacattcagctatatgacagaaagtaaatctatggatatggtattttgtgaatgatcttttaaataaaagaaaaccttacataaaaaatgaaaaaattatatatatatatatatatatatatatatatatatatatatatatatatatgtctgtcagactgtttcttagtcacagtattagtcaaggtttgctatccactctccccaccatcctgattcaaatgcatctgcagaagtttttgctccttcctttctgagtttcaggtatttcttctgattcctatccacttgtaaaatttggagtctagagggaaccaagggaaagcagtgattacaactgacatcttccagtttgattggtgaaaggagaaacctcacttccttaatgaacattgatcatagtaaaatgctgtcataactcaggagaattttgctaagcagagaggaattacaaaaaatattagaatacatattttcagagttctttgagaaatatttgataaggaacatgaacttgtttgtggtttcttttttgatagagcttctgcaacattcttttagaattaataacagtattgtgaaggttgaggctaatttttcgtttagcctggtgaatttctccacaggcttcacttttgggaaaataaggaagttctctaagtatccataaaacatgaaattagggatttattcaaataaacataattaaaattattttggaatagactttttctctccatttagttgtaataatttgtctagcttacagttcctttgttgtctatagatgtctgagaaatatttgttaattcttgggtatcattatatattttctaattggggctggcaattacaaaaacggcatagctaaataatctagaaacataagcctaattgtgtctgtgtgtgtgtgtgtgtgtgtgtgtgtgtgtgtataaccaattatcattattgtcctatttgatgacttcatcacttattgaaaaaaatcaagtctctttttgcctttgacaagtgttgctctagtaatgtgaatattttggagcttgttagaaatacaaaatctcaggccacactccaactaaatcaaaatttactacagtttaatcagatccccagatgttttatatgcacataaaatttaagaagcaatggaaaactgacattgttttgagtagtaattagaaatttgtaattaatttataattttaaaataaaattggaattattttgagaaagtcttataaattttaggagaataaaacagggccttcaaaataggctgttttcctgggttaagtaaaatttacttcataggtgaaaagaaattatttggcttttaatttcattatgctatgttacaaattgattctgatatataaagcaaaacaaaaaattgagtatcaccacttatattatttttaggaaacatgatcagaaatggctgttgtacgaatgtaggattctttttatcctaacattaaatccttacttgtgataagatactaacattcatagctttattttaactttaatattcaataaaagtaatgatagtttagtgattagatggagagtacatgttgactaagtatttcagttagcctagtattttagaacacgttttaagagtcaaaaaattctaaagcaccaaaggattgtgtgtgtgtgtgtgtgtgtgtgtgtttgactctgtaaacttattgagtagttaataatgctgacattcatttatagtgggcaaatgtgtgtttgtgtgtgtgtgtttgtgtgtgtgtgtgtgtggatttgaaatgatgaataagatttgttttgtattagggaaggatcacaggggatatatttagattaagtttaatagtagatggtgccctttgtttctgcagtacttttatactaaacttttcttttgtggagattatttcagtcatatttaataagatgcatatgtctgaattaatatgatcggctgtaacttctaatggcagtttttttacctctatattactatacagttttttctggaattaccacttttgaaggtaatttaccttttaccacatttttctgttgattttgaattctttttcaggagacaatggatatagttctaaataatgtatgaaataagttctacttgtagatcttttccttaacttcccttactaagaggagagtaagaggaattttagataggcgtagaggaataaaatggccaaagaaagatcatgtgtagaaaagcttcaacttgcatagctaaaatagcgaaccaagtggagatgccaagcacgaagattacaaccaaagatgatcctttctgcggcaaaaggcaaactggccacaagtcactgttctacacgttgaaaccagagaagagtttttcagaacgtgagtctgaacacagccttcagtcatggtggccttctttcagtgcctcatactctcactcctgtctccaagctgctgagtccttgctgttttcagggtctaatactctttcctccctctttggctagttaactcccagtcatctctagacctcagttcttgccacacttctcccagaaaacttactcctgatctctctgacatggtcaaatcaccatattatgggctcctggagcaccatgccaggtacctttactttccttcaattacttgttagggttgtttgtgtgattacttacttaacatgattctctctcaataaactattacctcagtgaaagcaggggccatgtccgtttctgctcacttttcttctttactccctagaataatgcctggctcaaaaataggcattcaacaaatatttgttcaattaataaataaaagttggtatcaggaattagaaaagcagtgagatgagcatcctgatactagggacaggaagggaagcattccttaggaaaatcatatagaagtctgtgttgtagaagaataaagaacaggcagttattgactttggaacctagtttaaatctaaaaatatcaggagcattagggaagcctgggactgagataagccaagattagacgtgtcctcagaagtaaagttggatcaacaagtttgccctttacaatggcaagtctccagcattgttctcattaccacttcctcttacctcccacctggaagactgtctcctcttgcccgtgggcaagtcctccttggagaagatagtttctcctggcaccttggcaaagatgactgactaattcttcatgacacgaattactttaaaattcatctagatgtcatttagatacaaaattcttttttcccttgatatttctagtgtacaattttcagcatgtcctcactcaatattgcttagatattaaatggaaatatttaaaaagatagccgtgttaagtcccatcatgattaggcaattttttcatggtgaattaggattgggtaagacatcatactgatgacttctatgtagaatatgctaaatttagcaaatcattgccactagtggtttctttgtattcaatagaaaagaaaattgtatatctattagtgaagtttgattacacataggtggacatagcattcgtaatcagatgtaaaatagtaacttacagctgtggctttcacatacccatatgcctcccaaaatgcttaggtctaattaaaatttgaaaggagcaaatttaggctatttaaggttaatctgttggttaatttgtacttcttattatagtaaaatatagataacataaaatttgccattttaaccattgcatttttaagtgtaaaatgcacatatcatcaaacgtactatcttaaccatctttaagtgtacagttcactggcattaagtacattcacatttttgtgctactgacctcagcatccattcacagaattcttttcatcttgcaaaactgaaactctttactcattaaacaacaatccctattattcctcccctcagcctctggcagccccattctactttctgtctctgaatttgacgactgcatgacgactgcatgcctcatataagtggaatcatacagtatctgtccttttgtgaatggcttatttcacttagcataatgtcttcagggttgatccatgcagtaccatgtatcagcactttctttttaaggctgaataaaaatgtatacacattttaaaatgtgtatacaacatttaaaaaatatttttaatttttatgggtacatagtaggtgtgtatatatggggtacatgagatgttttgatacaggcatgcaatgtgaaataatcacatcatggagaatggggtatccatcctctcaagcatttatcctttgtgttacaaacaatataactatattattttagttatattaaaatgtacaattaaattattcactatagtcagtcgactgagtgactctactatttgctgtcaaaaagaatgaacttattcattctttctaaatatatttttgtaagtattaaccttctccaccttcccctcacctccccacaccactagccttccctccctttggtaaccatccttctactctgtttaatttttagatcccacaaataagtgagaacatttgatatttgtctttctgtgcctagcttatttcacttgacataatgatctccagttccaaccatgtcgttgcaaatgacaggatctcattcttttttatggctgaatattactccattgtgtatatgtaccacattttctttattcacctgttgatggacacaagttgcttcaagatcttggctattgtgaacagaactgcaacaaactgcagaactgcaacaaatccctatcaaaataccaatgacattcttcacagaaatagaaaaaaaaaatcctaaaatgcatatggaaccacgaaagacccagaatagccactgggtcttctgggacccagtgcagatatcttactgatatcctgatttcctttctttggggtgtatacccagcagtaggattgctggatcatgtggcagctctgtttttagttttttgaggaaccactaaactattctccatagtggttgtactaatttacattcccaccaacagtatacgagggttgccttttctccacatcctcaccaggatttgttactgcttgtcttttggatataagccattttaactggggtgagatgctatctcattgtagtttttctttgcatttctgtgatggtcagtgacgctgcataccttttcatataccttatggccgtttgtatgtcttttgagaactgcctattcaaatcttttgcccatttttaaccagattattagatttttttttttcctatggagttgtttgagctccttacatattctggttgttaatcccttgtcaggtgggtagcttgcaaatatgttctcccattttgtgggttgtctcttcactttgttgactgtttcctttgctgtgcagaagcaaaggaccccatttgttcatttttgctttggttgcctgtgattgtggggtattactcaagaaatctttgccaagaccagtgtcctggagagcttctgcaatgttttctggtagtagtttcatagtttgaggtctttaagtctttaatcaattttgaattttgtatatagcaggagatacagatctagtttctttcttctgcccatggatatccagttttcccataaccatttattaaagagactggccttctccagtgtatgtccttggcacttttgtcgaaaatgagtgcactgtgggtgtgtggatttttttctgtgtactctgttctgttccactggtctctgtgtctctttttatgccagcaccatgctgtcttgtttactatacctcagtagtataatttgaagtcagttctgtgattcctccagttgtgttctttttgcttaggatagctttggctattctgggtcttttgtgattccatatacattttaggatggtcttttttctatttctgtgaagaatgtcattggtattttgatagggattgcattgaatctgtagattgctttgagtaatatggacattttaaaaaatattcattcttccaatccatgaacatgaaatatctttccattttttggtggtttcttccatttcttgcatcagtgttttatagttttcattgtagagatctttcacttctttggttaagttgattcctaggtgtttaactttatgtggggctattataaattaaattactttattttctctttcaggttgttgactgttggcatgtagaaatgctactgatttttgtgtgttaattttgtatcctgtaactttactgaatttatcacttctaatagttcttttgtggattctttaggtttttctaaatataagatcatctcatcagcaaataagaataatttgacttctcattgttcaattcccacctatgagtgagaacatgcggtgtttggttttttgtccttgtgatagtttgctgagaatgatggtttccgaacacaggaaggggaacatcacacaccagggcctgttgtggggtggggggaggggggagggatagcattaggagatatacctaatgtaaatgacgagttaatgggtgcagcacaccaacatggcacatgtatacatatgtaacaaacctgcacgttgtgcacatgtaccctagaacttaaagtattatatatatatgatatgtatatacatatatacaatacatatatacatatatacacacacacacacacacacacacacacacacacacacatatatatatatatatgaagaataatttgacttcttcctttccaatttggatgccatttatttatttctcttgcctggctgctctagctaggacttccagtactatgttgaataacagtggtggcagtgggcatctttgtcgtgttccagatcttgaaggaaaggctttcagtttttccctattcattatgatactagctgtgggactgccatatatggcatttattatgttaaggtatgttccttctatactcagttttttgggggtttttatcatgaagtgatgttgaattttattaaatgctttttcagcatcaaatgaaatgatcagatggtttttgttcgttattctgtagatacgatgtaccacattgattgatttgcatatgttgaacaagtcttgcatcccagggataaatacttggtcatgatgaatgatcgttttaaagtaatattactgtattcagttgctagtattttgttgaggttttttgcatcaatattcatcagatatattggcctgtagttttcttttttcaatgtgtctttggttttggtatcagggtaatacttgcctcatgtaatgagtttggcagtattctcttctatttttcagaatagtttgggtcagattggtattagttctcctttaaatatttggtagagttcacctgtgaagccattagctcccaggcttttctttactgtgagactttttattatggcttcaatctccttacttgttattggcctattcaagttttggatttctttatggttcaatcttggtaggttgtttttgtctagaaatttgctcatttcttcaagattttccagtttatcagcatgtagtttctcatagtagccactaatgatcctttgaatttctgcagtatcaagtgtaatgtgtccgtttttacctctgattttatttatttgggtcgtctttcttattttcttagtctagccaaaggtttgtcaactttaacttttcaaaatgcgaattttttgttttattgctcttttgtgttgcttcatttcaatttcatttgtctatggtcttatctttattatctcttccagtattttggttttggtttgctctcttttctagctctttaagatgcattgttaggttgtttatttgaagtttttcttcttttttgaggtaagcacatataactataaatttccctcttagtactgcttttgctatatcccataggtttttgtatgttgtgttttcattatcatttgtttcaagaaagttttcaatttccttcctaatttcttcattgatccacttgtcatttggaaatgtattgttcaattttcatgtattcgtgtagtttccaaaattcctcttgtcatcaatttctagttttattcttttgtagtcagagaagatgcttgagaggattttagtttttttgaatgttttaaggcttgttttgtaacctaacatggtctgtctttgagaatgatccatttgctgaggaaaagaatgcgtattctgcagtctttggatgaaatattctatacatgtctgttaggtccatttgttctatagtgtagataaactccaacgtttcttggttaatttctgtctggaatatctgtcaaatgctgaaagtggggtgttgaagtctccagctattattatattgggggttctctctctctttagcttcatttgatatttgctttatatatttgagttctccagtgctgtttgcatatatatttgaaattctcttgttgaattggcccctttatcattctattattttgcctctttttatagattttgtcttgaaatctatttttcctgatatgagtatagctactcctgctctttttgggtttccattggcttggaatatcttttccattcctttactttcagtctatgtgtgtctttataggtgaagtttcttataggcaacaaatcactgtgttttgttttgttttgtttttaaatttatgcagccactctatgactttttattggagagtttagtccatttgtattcagtgttactgttgataagtaaagacttcctcctgccattttgttatttgttttctggttgttttatggtctcttccttctttctttctttctgttctatcttccttttagtgaaagtgattttctctgttgaaatgatttagtttcttggtttgaggttcccatgagccttgcaaatactatcttaataaccattattttaagctgatgagaacttaacactgtttgcactaacaaacaaacaagcaaaaagaaaagtaataaaaactctatgcctcaacttcatactcccactatttaactttttgttgtttctatttagatcttattgtactgtctatgtcttgaaaagctgttgtagttattatttttgattggttcattgtttagtctttctgcttaggataaaaggaatttacacgccacaattacagtgttggtataatattctgtgttttttttgtgtggttactattgccagtaagttttttacctttagatgactagttattgctcataaatgtccttttctttctgattgaagtacttcctttagcatttcttgcaggacaggtctcatgttgaggaaattccacagcttttgtttggaaaagtctttatttctccctcatgtttgaagaatatttttgctgtttatactcttctagggtaaaagttttttccttcatcactttaaatatgtcatgccactctctgctggcctataagttttccaccgaaaactctgtcatcagatctattggagctccattgtatgttgtttgtttgtgttctcttgttgctttgaggatcctttatccttgacttttggacttgaggtagtcaaggcatttaataatccctgttaaaagactctgatgcatttttcagtatgacaattgtgtttttcagctccagtatttctgcttgattcttttaaattatttcaatctctttgttaaatttatctaatattgtctttgggttaaatctgcttgctgttctataaccttcttgtacttaggtatcgatgtatttctctaggtttgggaagttctctgttattattcctttcaataaaccttctacccctgactttttcctctacctcctgattaagggcaataactcttatatattcccttttgaggtgcctgtaggcatggttaattgttttttattcttgttttaatctcttctgactgtgcattttcaaatagccagtcttcaagctcacgaattctttgttctgcttgaccaaatctgctgttaaaagactctgatgcatttttcagtatgacaattgcatttttcagctccagtatttctgcttgattcttttagattatttcaatctctttgttaaatttatctgatagaattctgaattccttctctgtgttatcttgaaatttctttaagtttcctcaaaatagctattttgaattctctacctgaaatgtcacatatcttttgtttttccaggattggtacctggtgccttatttcgttcatttgatgaggttatgttttcctgaattgtcctaatacttgtagatgtttatctgttgctgggcattgaaaagttaggaatttattagagtttttgcagccaagacttgtttgtacccatccttcttgggaaggcattccagatattcaaaaggacttaggtgttatgatctaagctgtatctgcctcagggagcaccccaagcccggtgatgctgtgcttcttacagactcatagaggcctccttgatgatcttggacaagatctgggataattctctggattacctggcagagacttttgttctcttcccttactgtctcccaaataaacagtctctcactctgttgtgagccacctgaagctgtgggtggagtgagacaagcacccttgtggccaccaccaccatgactgtgctgggtcatacctgaagccaacacagcactacatcttgctcaagtcctgctttaacccctccctggctactgcttatgttctctcaagaccctgaggctctacagtcagcaaatgccaaagccagtgggcttgtgttcttcccttcagggcagcaatttcccccaggccctgggtgggtccagaggtgctgtctgggagccagggactagcatttaaaaccttagaagtgcacctggtgttctgttgtactgtggctgatctgacactcaaaccacaagatgtagttcttcccactcttctctcccctttccaaaggcagaggatccccaccccatggccactgtcaccacaaaaccatggtaagtagtgccaaactaccactgctgtttccttaaggcctgaggtctcttcaatcagcttgtagcgaatgctgcctggcctgggcctcacccttcaaggacagtgggctcccctctggcccagggcaggtccagaaatgccatccatccaagagccaagtcctagaattgtggaccccaagaacctgctttgttctctagccccctatgcatgagctggtacctaaggtacaagacaaagtcccctttcctttttcttctgcttttttgaagcagaaggaattgtgccccgtagtcaaccgcagctccagatgtgctgggtctcacctgaagccaacaagtctcacagtctcacacagggcccttgatttagtacttgggtatcattgctgctttttcagggcccaagggctcttcagttagctggtgatgaatggtgccaggatggggtcattcccttctggaccagggtatgtctaggaatgtcatccaggagcttgggcctggaaaggggccctcatgactctgaccagtgccctatcctgccatggctaagctagtatccaagatgcaagataaagttttccctgttttctcctcaagcggaaggaaggagtctcttttggagccatgagctgtaaagcctggggttagggaagagataataccagcactctcttggccaccctggctggtgttttagtatgttgtgtgtcacccctatccactgtctctgggccctgttcagcattagaactctcctaggatttgcagtccttgtggcctagactgtgtttcaagtttatttatttaaatcctcatagcactttagcccatggtgtccaggtttgtgggaactcaggttccaactgccaggattgatgattccgctctggctagggctggtttaaatgctccctctgtgggtgggcatcagctgagtttggtcttgttttcctttctgctctatcaggacagcagcaagttcaatgcctcacaattgctgtgctctccctccagcacaaagaaacactctagtcaccacgctaccactgcctgggcttcaggaaggtgtggcatcactgatttaagatggtttttttttttttttttttaaggttttcagtgcctttttcagtgatgcgaagttaaaactgggtactgtgagtgctcacctgatgtttggttcctatgagggtgcttttttgtgtagataattattaaattggtgtccttgcggggggctagggaaggcaattggtggagccttctgttctaccatcttgctccacctcctccaacattttctttatctacttatacatcagtggacacttgggttgcttccacctctcgcctattgtgaataatgcttttatgaacataggtgtacaactatctcttcaaatatctgctttcattttgtttgggtatgtagcctgaagtggaattgctgaattctatggtaatcttttttttattttatatttatttttttctttgttttttggagagtagttttattagcttgggatataatgggatcatcactaggagggcagggtattccactggttaccacgtgcagctgtctggggagcatgataaaattcagtccagggttctgtgctggggagcagggccttgaaaagaaggcaaattgtccagggaagtagtagctgtgagggtcatggctaccttgctccactctactgcactggatctcctggtgcttttcaggctcctgtcaatcctgcatctgtatggggcaatggaccatctggcccaaaacttcatcctcaagtttgatgtaggccaggcatttctgcttctttccactggacttgactttgcactcaggattcttcttgcagaaatttatatactggagcttaaattctagccccacaaagttccctgctggggagagtgtatccatagcactgctcatattggtctccctgaaggctcactgcataagtggatgcttatggaatttccccagggtacctgcaggccctgctgctaggcctttaggagctcagccccgcctaatcccatggtgcccagccataggtccagcaggatcagcagctactgcatgggtttccctcagtcaccctggaccttctttcctgtgccttcaagaaatttcctaaccttcaccatggctaaatcttggcctcagctgtcaatctcttcctggtcttctccccctgcacatccctgcccctgatgctctttcctactgtgggggcctgttttcacttatgtacttattttctccctggaattataaaccctgttgatagactgtaacatccttaaagtcagcaaagataaacatgtttctatcttcatgataaccagttattatttggtctacaatacaatgtaatttttttaaatgtattttcagccttgctgtaagaaacagtctaatgggaacttatagttgtgtttatcaaaagagtttattgaaggtgttgtttattacattacacaaggatttcttcccacaagaaatcctttttgctgactttagtgtcaaaaatggatgggcatgtttgaggtgatggatattccaattaccctgtttttatcattatactttgtataatgtatcagaatatcacatgtatctcataagtatatacagttattatgtatcaatttaagaaaagactggatgggcttctccgagaaactggcttgctgttatctaatgaatgttttaaactattaatgtttttcatttgtatgaattttttatattttcattattctggctcccactttatgactaaccatattttcctcatctactttgaatttgtattgccctcctgaattgtgtgtgtgtaaacaatatacttaaatgccttttgatgcaaagcataatttaaataaatatatattaaacaaagaccttaaagttttaatggaaaatagaaaaacatttttggtataatgacttttggtatggtacaaacaaacagtctagaggtttggaaaccatcctttccgttcctccctcactcctaattctgcatagtctttaagagcatggatttagaggcaaatggacttgggtttagaccttgccttaccatttataagctgttggatcccaggcatggtccctaaatttaaattttcttatctgtaaaatcaagataatgatatacagttcataaataatagaaggtattactattattcagcatcaattcttctatatagaattgatataaaactattgaaagtgtagcctttttcaaaataagttaggacagagtaaatgagaacagtcccagaagaaaattatccttccttttaaaattttatttggttttcttgagaatccttgtgaaaacaaatcatatgctacttgttatagagcgactgcttgcttgtaggaggacgactgttaaggatgcctttgaagaacataaagaacaggggtttctcaggtcaacatgtattatattggtatctaaaaactatttgcaatgtttcccctttcattcattcaaatgccacttcagattgaatgccatctgggtactctacacagtattgaattcatcaagagtatgctagcatggactttagtccttggtagttttaattttttttttctggtaggtctagaagagtgtgatttcattagccactgttgtatgttattctttttcattttaataactgtatgtttctatctctctttacccatttatttttgcaagggtatgaatccactttattgttgagatgtgttttttcagtcttgagatggtccgatatagtcgaattaggtttgattttggatcctctgggaccaggttttaattattggtttgcctgtgagttacttactgtgtacacttagagaattacctaatctcactgagctttaatttcttcacttctgaaattggtataacagcagtctctttgacacgacttggcatctttctgtttacttcccatcctcaccattatcctgtaatcttctaaaggaatattctacatgcaaggccttcactttctcatttcccagtcactgctcaatcccgtagtctgtctggcttctctttgccttattctaatactgttctggctaaaatcattgataatctcttaattctcagagtgctttagtccttatcttactagaatgctgtgttgcatttaacacttgtctgtcgtgcctttcttattattaccttgtcctctctgatccatttttgttttcattcttagatgcccctttgtctggccaaccctcaagttgtatggaccactatacctttcaccctatacagttgagggagattggttccaggaacccccacagataccaaactctgcaaatgctcatgtcccttatataaaatagtatggtatttggatataatctatgaaatcctcttgtatactttaagtcatctctaggttacaaataatacctaatacaagtactgcattccttgaggtctgtgtcttatttacccttttatctccagcgttcacagcagtgtctgacaaataattccttcatttttccccttgttcctgactttagagtcttccttttaaaatataaatcctgtttagctctgtgacactgtaattactaccaactccatttagatattcagcacatatttgtaatagtatcaatttacatgtttattttatttacaaataactcagtgaactctcacacagatccataatgttgtcttatagttattaggcagggagtccctcatcttactcacaggctataaatctacctgcatctacacccatcttctcctccttccctcctttttcaatagagatatacagttcttatccacatttaaatatcttcaagtctctaacatctttaagaaagaaaaacagactctctctctcaatcccatattctctagatatcctcttatttttctcttctcttacgtagcctgactgctttgaagactcctcaacccattcgatgctggcttattgccatcactgtgaaaacaactctcaggaatatcactagtgactttcacattgctatatccagtgagaacatttcagccctcatcagtatacacatactaatggagaatgaaagaaaaagaagattgtatagggaggctacaaagtaattctagttactttaaggaattttgagactatagtaaagacatctgtggccttatactagaccctgtcaggaatcacactgcttttaggactgactcattttctttctcaatggctacataatctctctgtttggaaacttgacttccttttgcacatcttttctaatttcatctctgttttttctattctcttataatttctgctcctccataacttcagctggaatgtagccccttatagcctctggtctccctccttgacataatgaggacctcttagtttcagctaattgccttattttcttggtattctttacttaaatttctagagcgttagttttattagtccagttcatcatttgtatcaggccacttcacaggtgattgaaaccgcctcaatctatagcctagccaatcacttatgaattgccctgggtaatcctgatttctacttttggatttgagtaaaatccaaatgataatggattaaggagcgcatcacaggtgaggaaataagggtaagggcttgaatccaaagagggtgacagactagtggggagcacacatgatcaacaaaatcaaataaaggattttgtgttttattttaagatggcagagatttgaacatagaatgagtcaataggcaatagttgaaacaaagagagaatttaattttttagttattgaagttgtgttaaggtggcagaagatgggactacagagtacagaaagatagattagctttaaataggaaggatacctcttcctctgaagtggagtttaagtaagaaagtaagaatttgatgcagataaatttgaaaataggggaacctgcctgttggcatactttatgaaatagtcagcaaggagaactgcacagaagaaagataaagatttccagtacgtgctgaggaaaattcaactaggtacctaacaactacgagtatgatgaagtgattttctttttcactgtagcccatatgtaggttaagaaagggcgaaggatttggctagttcagagttaaaatggacttaatttgtgacatggtagcattaatgcttgcttctaacccacccttcacatttatttggtttgaccatgttttcattctggtctttcatacttttattttgtaggtcttgatgactgtttgcagcagtatattaagaactttgagagggagaagatcagtggggaccagctgctgcgcattacacatcaggagctagaagatctgggggtcagccgcattggccatcaggaactgatcttggaagcagttgaccttctgtgtgcattggtaaggacataaaactggtgaagagggaaacttctctttttcttcttttgttgcttttcccttttttcttctcctcttttgataatcgaaatgcaaatagaagaaaaaaactctgattctcaaccagctggacctgatattttcttccttccttaaatttattatattagtgccaaataacagttccctgtttgtaacatcttttataacagtaagacttgggtatatcagaaccttaagtccagagtgtatgtctcataagcagggctcttcatagatgaaccactcatgtgctaggctctcacactgccagttgagaaaggaaagaatattgattgacagtgttacatacatacagtctagacgtttgaagtttgacccatgaacaaggctctgccgacctaaacctacttaaaaggatggcatcagaaatagatgtctagaccacttctaagtttgaaccatgtagctgtggtgaatcctttctgatgctgagctttaatccctgtacagttctgggtttaagcaccaggtttaagtcatgtcatttggatagttcattatgtgattgagctcttctggaagttaatgcggaaaataaatttaaacaccatttttttttctgtttattcagcaattccttagtcgcagtccccaaagaggtcaaatgttaaacttccttcttaccccttcctaatgtagtggatatacatcaacaagtcagaagtacagatgtatttcagtttatgcaacagatgctttctggggaatataaagcaaatttctgggtagtgaattctaattttcttctacataccattatgaaatcaggaggtgagattccttatcaacaagctgagttgactagtccaggaagttgtgctattgggactatatctttacctccttcccctctatccccaactactctttgaatttccgtttaccctgctaagtcttgtctctctgatctttactggcctttctacattttccttatgtctactgtattcatttctttttcaacaattacatattcatgctcaaacagtgctatcacggggaatgcaaagatgaaaaagacagtctgtactcctgaaacatatacagtccattaagaaagacaatagccatcagaagacaacatagatttaaagaaaattccaggggagtgtagaaggaaatgaacacttctgagggattcaggaagtgtaggtaagatatgcatttggtcttgcaggatgatgagatgtttgccagacaaaaagttggagaaaagttatctaggcagaagaaatatcatgtgtaaagacagaattgtgaaagaatatggaatattcagagaaaattgagaattttcatttagcttgtgcagaatgggaagtgatgggaaaaaagggaacttaacaccttgtattacaattctttgcttaggttcttttatcctttaattcatgttgggctcctcaaaggaagacatctttgtttagttcatattttttattcagctttctgcccagtgcttagctcataaaagatgctaaattaatgttatcttactgaattaaactctctgtctttcttcagagaagcataatttttctcttacctgcatagcctttgactttgaagtttctgttcctcatataaaggaagacatagaaaaattagcagattccttttgtttctttaagctatactatattttcgtctaccttgtcttgaagttattccttatgtgaataaatgtttatggcagctgatgagaatcaaaggtttatttagtcacttgtttattcatgcaacatatatttattaagcatcagatatattgtttgcatcatgttattctagaaagaagtaagctgttcatgatttggaggtgtaataatatttcaagctattaagctataatttagtatgctttaatagagagcaaagatattaactgaaagagtaaaaatgtaaataaaaatatatatatagcttaacgtatggtccttaatttgtgttctgacaatacactttttattaggaactgtaaataaatcatttatgacaggataagaacagttttcatttcatttttcatgtacttataatttcaggcattttgcatgaaagatttgatgtttgcaattgctgggatttgtttctttgcaacataattgcttggttcattcatcttaaaataatttattttccaaaaaaattcattaaagcaagccttttaggactcactcatatttataaagcaatgtattataaagctaaaaaggtgctacacgatgcattcaaattaagaactctgaataaaatggcattgacattgtaaaatctgttgttgccaatattaagtatttctagttaagtggttagtgaaaatttgccactagtgaggatatagctgaccttatttttctaaaatgttaaatacatttctttatttctttcaaatgcttttgcatgcatatgattgaaagagaaggctgatatgaacttagcataaattcattaagacttaaatggctgtgttgaatcagttctaagtcattactggttctggcacatggtaatggccaagtatatgaacaaataagtaacatatatgacaaacacagcagctaagtacatttcatgtataagtttttgttttcttgaggtagtcctttttatactaatagtaataccaagttttgctatgcatatccaataaaaagcaaatctgtggtgaataaacctgcatttttaaaaagttgaggcagtgccctccgtacccctggcctaacacaaaaggtgcttgatatacttgtcagttctttaaatggtaggtaagggtgtgtgatttactggtgacttaccatgtcacaacaaaccatccacttacatgaaagaaatagccagaaggtatctgtattggtagtaattgagaattgtaattataaaaattaacctgaggctgggcatggtggcatgcctgtaattccagcactttgggagcctgaggagggcagatcacttgagcctaggagttcaagaccagcctgggcaatgtagcaagaccacatctctacaaaaaatttaaaaattagccaggtgtgctggcatacacctgtagtaccaggtacttagaaggctgaggtggaaggatcgcttgaacccaggaagtccaggctgcagtgagctgtgataatgccactgcactccatcctgggtgacagaacgagaccctgtatcaaaaaaataaaataaaataaattttaaaaattaaaaagttaacttgagagatcaattaatctcttttgttaaaatagtagcacataaatctggttacatacagatgagcttcttacctattatactcttctaaatttttaaaacatgtttttagattatcagtgtagttatgttcattaactagagcaagttttaacaatttccttccccatcctctgctacatatcttttaaagattcttttttcctctgcatttctctgtcctctacatttttcacctctattctgcgtaatatatttttaggaggtttccaagttagaacctctgagagtatccttccaggttttgtccggatgattattatattccctaattcttgagtcatatgaaaaataataattttagtttcttaaattttgaagactctggaatatttttactttgcctttggatttttacttataagaagattaatattattttacctttcctaataaatcatttgagatgctagtgttatatagagataaacaatttaaaataatcttttatggaggctaatagctacagagtgaaatatcagttaccaagttgagtaggtttctcgctaataaattgttataatttgaacttctctaagagattactataatttgttggcaaacaaatgttttcttattaaactcatttatacacaaaaatgaaaaatacaatcattttttactttagaaaaatgctttaacacagggaaaacttctgaaaatactttgcttttcagtattttcatttacaattacatttacagaagaaatatcatttacagttagtttgtatagttataaattgttcttatctagtcattagagagcatcttttataaacataagaggatttctttcatactgtagtgaccggctggacaaactctcccacatttcacaaataatccattcttaaatgcaatagaatttgaatagaatgttgttttatttgcccaagcaaatcttttaacatgagagaagaatattacagttcaaattaagcagtgaatatttaacatattaatactatgttattttagaaaacaaatttataactttagaagaaagtgttcttttaataaatatgtaaattcccagcaaaagacaagcagacttttatcacgattaaatctgtagtggtaacatacataacttggtatttaatgtttaggcatcaaaaccttcctctcccctcattttgtctccactaagttttctcttgtcttaaattgtcataggaaaaaaagacacctaaatgttatatacaaagtaggtacccagtgattgttgacttaataacatagcttaattcattgtatggcttactttcctttttcacccttcatcttccactttgacttaattattgttaccatgtttctgagaataggagtagaatattggtgctaaggaatgtggtagacatatccgctcacagatggcctggtgacttgtagttccattctgaactctgtctagtccaagtacagagttttttaagcaaactgttaaaaaagaaatcttcccatacctcagtttccccaactgtgaaaaggtaagtcaaacttagcctcccaggcccaagcaaattcttacattctttgggttttgccattttaagtaaggtggtaataactttaactttacacacaacagtaatgtgcatgctgctaagtgttttaatcaaggttatccttggataatattaaccagcctttttaaggggtgttttacaacacacaattagctgctttacattttaattgtaacttttgaaaactttccccaaagtttgaagggatcctacaatctttttctatttgaagatagtaaaaaggcttattacacttattcatataacccgtttctgctataaagtataatagataagatatttaggatgaattaacaaatattagttgaaatgtgagaacaaagaaaagaagaaaacaaatacacttaccaaaaagtcactgtgattgcttttggtgtgcttcatatttagttgtgagctaatacagccaggacaaaaacaaaaataattttagtttcataatttgtattacaaaaaggagaaagtatattagttcccctgaggaagcagagtttttcctgataccatattataaaagaaacttcttatacatcattatgtagagtacgtatttttttatctgatttatttacctgatttatttcttgctttttcattttattattgttggttgtgtttattttcctaactttggggaagcagaattatccctagtacctacattcctgaccatgtgtattgttaatagaatatctactcaaaaataattgttgataataattaatttcacaagtaaataaacttaggttttggttttaaaaaacaaatttattatttcttacaatcttgctttcttgggtagcatagttctaagatacaatgcccttatctttccatgttcatattagtacttaacacattttattataatttctttatatgacatcttcccaaatagtcacttaactgtgggctccgctaggtcaggaatcctatcttattcatttgtaactcgaatgctaccccattgcctgtgcataataaagtattcagtaaatattttcatgaatgaataaaactgactttaaatatattctctctcttttttataattcagaattatggcttggaaacagaaaatctaaaaaccctttctcacaagttgaatgcatctgccaaaaatctgcagaattttataacaggaaggagaaggagtggccattatgatgggaggaccagccgaaaattgccaaacgactttctgacctcagttgtggatctgattggagcagccaagagtctgcttgcctggttggacaggtaaagtcttccgcatgtttcataagtatcctctcctcagacaccagtttgaatataacattattttgcattttgttgtgaaaggattggacaggcagaggagtaccaagtaataaatgtctaatgatgatttaccacaatataggggtattaaatagatattagtcttttataaaatttgatgtccaactaagtagccaatcaataattagtctgacaactgtaaaataccttgctgctttataagcaaaatcattatttggctgtcataataaaatttataaatttttgtttattataatactgctttgtgtcctgatgttctttattcatattaattggttgtacttaaggaaatgaccattgggattctataaactgttttaaataggtaattagacactgacaccttcatagcatgccttgtatgtctccttggcctcgcttcattcattctctgttattaattacattgtactattttggatatcataaacacacttttagacttttttaagtttagttgactttcatttgttttggaacacataaaatagtataaaagtcttgtaatatgaaatgaaaatgttagatttaaattatatactgtatgtggttaaacattatcatgataaaacacattacaactgtttattaaaaaactaaacaaattctctactttcagttttggaatttttggtaaggggtatgtactatgtttaatggcttaataatcaaattttaaaaatgctctttgtctttcataagaaactctgataatatacattaccagaattctttcttgaataattgtcagtaggatattcatatgtgttcctacacacacacacacacacacacacacacacacacacacacacgccagtattacattttggcattttaaaaacatgaggccttatattaaaagtaaagcttttgtatttttaaggtgaaaattgagataattttccttaattttatattgtctaattttatatatacttatacataatataaagtgatgatactaaatccaaatatgaaacactaaactatatattactagctttttgataattaattaatggactacatgtttattttgcattataacattattaaaatttaattttcataattgtctaagccacattatcaagtgtttaaattaattgaattttaaatatatacattccaaaagttatgaatggtcagtaagtaaaatatggcttagtccttaagtactattaatataatacatttgttttggtaggctttacagtaatcagaaggcttaaagaacacatccttgattataattgtatcttcttttactctcattttccctataattataaatttgctcagccttgatatctgcatttagtaaattcatttatatattttttaccctagtatttgttagatggatagataaactgttagagtgaatagaaaatgtttttacttcttgatgacagatatggctatttataaaatcgcacatttcccacactatagtagtccttgagattttatcgtatcaattttttatggtggtattactttcattatgtaataaaatgcttttggtaagtgccaaatcacctacaaaacacatatgtgcatgcacacctacaaaagcacataaaaacacacccagtgtgtcagtgcagatttgctttaatttgagggatttaaaatgaaccctgcaaatgaatactgccaagcatttgatctttaactttagtttattccttcaatatacaatactttagatgaagaataaaaattttgtcagttaaataggattaatttgatgttataagcacctgttttcatttttaaacagctataagttttatggcattacaaaatttttattacattttggagaaaacgtgtatccacagcaatatgttttgggtttattacagtttttattttatgtcacttgaaagaggagaaagaaaaagaaagaataggttaaaaaaaatctttaattttattctagatgctgaactagatgctttatacataagtatatatactctcagctcattgaattctcacagagcagatattgttatctccattttacatatgaaatgtgaaataacttgcctaaagtcattcatctagtatgaaagttatactttgaatttatttttgtctgacattgaagtcctgttattttttccttcatgttcctttatcatgctacacctcgttttgaatgctgactaattcttgaggattttgaggaagggatatggcatataaacctttatttacattttgctatttctcttcaaaagctaaataagactaccacttttctgttttgggcctcagtatctgaaattgctacatagaacttcatttatagaaaatgtttatttcactgtttatggtaaaagtttactattttctctcatttttaacattaatatttaattctaattgtttctaaaatacctttcaagattattctattttaaagggatcattgaaatatttttgataacattgcaaaacctttaaatgtttagggcgtaatagtgtgctaggaaaataatatttatgactcacaaaaactccagtttcaatggagcttccatttaaatgagatacacgttcaaagaccagctccttacatttcctaaataagataaaatctaaggttaacacaattccattttttctcctatttaaaatattgatttcagtgaaacaccagactttcccagaggaatagtctcagaggtgaatcacagttggtagctttactgtttattttcaatgcatggtttacttgtctgtttttaacctacatcctactgtttttgacacctcatatttcttgcagttttctgtggctttgccaaatcgatctatactcagaagtttacagatcactacaagtgttacgttgtacagtaacattagtaaaaatgttcaaaattattattaaacaaagtttattttgcctttcatagtaaaagtttttttccttcatttttaccagtaatacccaattctgagagtttataaaatacctttttaaggtcatcctgttttgatgggatcagtgagatctcttgatatcattgaaaaccttttacatatttaaggcataagagtttaaggtactagggaatttttgttaagatttctctgaaattttttgtcttatgtaagaaaattgttaaactaatttcttcttccatgataagaaactaaaggacaaattaattttataccaggaaaaatattacagagaccaagaaaaccacatcaaacgctaccagataatgtgatccattgtttggtcttattttctctcatgtgctcattgtttctcacttagcactaattattcaagggaagagcagtgacattagcactaccattattcacagactaccctaaggtttcagcagtgccaacctgagaaatagtaaggcattccagattttccttattaacctcttagctttccttattagtttctaatttgtttaggatttctgaatcgttaataacctttttataaatgtaatacttttgtttagatataatgtacaaagaataatttcttatagggtcttaaacttttgcaccagagagaaatataagcatcgtattatctatatgatgatttaaggagtacagtcgcttaatttttaagatttaaataggataattcctgtaacagccacttatcgatgatccaaggattttatctttttttctctttctggcatcaaaaagctttcttgctatgaatttaatttcctttaattagagttattgtgttcttcttgtaagtaccctgaactctacttgaggatttcttcagacttaagaacagtttctttatttttgtttttgtttttgtgtgtgtgtgtatgtgcatgcatgctgatcatgttcagttattctacagagatctatcgtttttactctcatagatgatcattaagtcatgactgagtgataatctttggtaacccacaaagattggagccccacctgaccttttacccttatttatatgtagatacagcccaaatcatcataccaaaccttaaaatctgctggctaagaatggctgttagtacagttgtatatgatttgcctctaagataaaaactttagggtaattctaaatcactacaaaataaaatctgttttccttggtatgtgtttagatttttcttttcattttttcttgaaatttaatcttgagtgaaaagcttgtcctacttaaaatatgaatggtcaggaaagtggaagacatgccttggaattcagtttgctataggcatttagtgatcaaatagattttttcttttctatatttgaacatcaagtgagattcttttaagtagttatggtaaaacaaaacaaaacaaaacaaacatgctgtgcatcacctcatcacttcttaatgaaattttaagattttataaacagactctgaccttttcaaacctaggaatcgaaactcttttctaatcatgccagaagcacttttgaattcttagtttaaaatgccagtttttatgcttcaatgcagcaaaaatggtctctatgtagttttttttttttttttttttgagacagtctcactctgtcgcccagcctagagtgcagtggcgtgatctcggctcactgcaacctctgctgcccaggttcaagcgattctcctgcctcagtctcctgagtagctgggattacaggcacccgtcaccatgcctagctaatttttgtatttttagaagagacggggtttcaccatcttggccaggctggtcttgaactcctgacctcgtgatccacctgcctcggcctcccaaagtaatttttttaaattaatgatattctcctagaagtgcttatatttttcattaaaaatatttttattgaggcctaatttatattctataaattaacctattttaagtatacagtttgatgggttttagtaaattttgataacacctaatacaaccacctttacaatccagtgttagaaaacttccatcaggatggatttttaacagttggtttctgcttacaactaaagaggttaattttttttaactgacaattttgattaatcacatttttttctaattcagttttttaaattcttatgtctccttttatttaagtaaattatcttgaaaaaatatactgggtttaggagtaggaatagataagttcatgaaagagagcctataatacactgtggtgtagtcatgcattgctaatgataaggattggcaattttgttgttgtgcaaacatcatagagtgtgcttacataacctagatgatacagcctactacacacctaaactatatggtatagcctgttgctcctaggctagaaacctgtacagcatgtgactgtactgaatactataggcaattgtaacagaatggtaagtatttgttccatatctaaacccagaaaaggtacagtaagaatacagtattataatcttatgggaccattgtggtatatgcggtctgttgttgaccaaaacgtcattttatgcagcacatgaccgtatatagaatcatttagaaaacaatatgttaaaaccactagaaaaagaaagggccatttaataaattgtagtggggcgcttggttaagcctttggaaaataaataatgatagagcactatctatttttcttcactaaaataaattttagatatatcagatatctaagaagaaaatataaatttacaagaaaactagaaaaaatataggcaaaaatgatttctagatgtggaaagactttctaagtatttttaaaatggaataaaatacaaaggaatgtactgttgactacataaaaaagaaaaacgtaataaagtataagacagaagacaagctgggaaaaatatttgcaacaaacagatatgaaaagcagagggttaatgtgtaatgtgtaatattcatatattaacatatgtgaatattcatattgataaaaaacaaagcccaccaaaacgtaacagatgagtatataagtaggtaaatcaaaaaagaagaaacagaaatcactggtaaaatgtgtatatcaaacaacagagctttaaagtgcatgagcaaaaactgacagaatgaaagaggaagtagacaaatccacagttgtagacttcatttcctctttctcaagaatagataaaattaaacagaaagtaagattagaagagctgagcaccaccacctaagaacaggatgttttgacatttttagagcacttcatccaacaacaggagaataaaaattcttttcaagtacccattgaacattcaccaagatagaccatatctgtatcataaaacaaaattcaacaagtttaaaagaattgaaatcagataataaaatgaaactggtaactcatacagcacacttataagtaatccaacggtcaagtctcatggaaaataaaaagtaatacattgaacagaatgaaaaaagaccaaatcataatttgtggcacacagctaaagcagtgctgaaaaggaagtgtatagcactgaatgcttatatatatcagaaatatatatattcaaaatatatcagaaatatatatagtaaatatatcagaagcactgaatgctttatatcagaaaagatctcaaatcaatcatttaagttcccatctcaagaaaatagaaaaataagaacaaaataagtacggagcaataagatcctcttaatgataagagcagaaattagcaaaattgaaaacaatagagaagtcaatcaaaatgtaaaggttaatgaacaaatattacagataacttcacatataaatttggcagctcagatgaaatggtccaattccttgagaaacggtactaaaacaacccaaaatgaaatagatactctgaataatcccataactattgaagaaagtgaatattacctagaaacgcctcagggtgtggaaaaaatctgcaggctcaaatgatttcattgttgaattttatatatttgaagaagaaacaccatttctataccatctcttccggaaaataaaggcaggaacttttcctatatcattttttgaggcaatcattatcctgatatacccctcccccccaaaaaaaaactacagaccaatatttctcaggaacttagatgttaaaaccttcaacaaaatattaccaaactaaatctaaacgtgtaaaaagaattagacacatgactaaatgagttgcttcaaacacttgaagatacatcagtatacaggtccaccatttactagttgtgtgaccttagataagtcacttaatctttctctaccttatgcttctcctctgtaaaatgagaataataatagtgcctatctcataatagttgtgaagattaaattacctgatacaggtaaagcatttagaatagtaactggcacatagtgagccctcagtaaaccttagcagttgttattactagctcttgattgtgaatattctaagtagatactgtactcagaatcttagattcttttgaaaataaactgacatgttatctttgcctaaagtattccttttttgttttagatgtagtgaagataccttgtaagaaccaaagaacttaaataattaagaactttaaaaagagagaaatttggtagaaagcaaacattatatttcctgaatttaattttcttccaatcatttctttcaaatctttccttaaaataagtcctgaatatttttatcagtatggaaatttcagaacaatttatttcatattattgataaactcattttaggctactatattttgggacttttcaaaagctgttactagtaatcacaattttccttttccctttataggtcaccatttgctgctgtgacagactattcagttacaagaaataatgtcatacaactctgcctggagttaacaacaattgtgcaacaggtattagctgacaaactttccttctgttaatttattagcaacttcatattccaacaatgggaagtatcctatgtaccaagagtttttaagatactggtttagaagtttctcaaagacaaaccattctaaagaaatgaaatgtgtagttatttattgggagactgtgcatttagctcagttagcttaccagaagatataaaaggaacctgacctgtacacacacaaacaaatgtgcctaatagcttttaacagtgatctaattacctgaactgattttccacttcaaatattatctaagccagggatccccaaaccagatgccttcagggtccagcagctaatataaatgtttaaattaagtccggtataaggcaaggagaaatggaagagacttgggtgaattgactggaacatatcccatatccaaacatatcttttagaggaaatgtaattataggcatgatatattagtgcttgtaaattatctcttaaataatctgttctttttctactgttatgtgatgatatctcttttcagtaccaagtttttctgggctctgtggtctcttgctaccagtagtagcaagaagaataaggattaataggtaaaataatgaaataaaatagttaagtgtttatttctttatggtgaaactatgggtgattttatttagactcgacttttctctattttccaaatgaatttttattttctaaaatgaatttgagttatcaaaaaacaaaaaagaatgttaagtacattgaagaaatacctctttaagtttgccaaaggaacacagcttagacaaatactgaaattatactttaaaataaattacatagcttacgaacagttaatgttcatctaatcatctaattcagccattatatacatactaatcactgcatttgattggaattgtatgaagtatctgaagacaggaattaaacttaagctgccagtaaaagaggccaatttgaataagcaaggtgtagacttttaaaaaaatctaggacatgcatttattaccaggctttcaagaaatctcttctgaacagttatgatgatgattatgctttgaaatatgctgtgcttcaaattatttttcattcagctttaattatttttattccctttgcagcaagatgagataatcaatatctaaaaataaactgtcacaaatggcttttttccccttcctaaaacaaagtggtgctactatgaagtaaaaggaaagtgcttcttgatattggccacttacatttaaaataatactaaaattagaggagaaagttaatgtcagtttcttttgaaaacctccatttgcaggaatttgtttaatctgctatatttattttacttattcccagttgtgatgggtttggatcattgtatttgaagccttttaaagagatttccgcccccctccccaacactttcctcatcacataagattggttataatgacacttttgaaaaaaaaaaagagaaactggttttaaaatcttaaatagaattctcacaaagaactgaagcttcatttagaacactgacagcaactgaatcagaacaatgagacaggtacccacacactacttgtcagcctttaaataattgccatgatgccttccttaatggatatcagcttaacctaaaattattctactgtaccatttttatgttctccacttcaaacacaaaaatgatgaattagattgccactagttaagaaataagcacaaaagtgttggtttgcaagatgaaactttggtgaagcttaaaatacatggggcaaggttgtaatcttggaagatttgagactcagccctgtttttcatgatgattccacattggacaaacgatgtcattgttttcgccatctgtaaacagaaataatcacctctacctcaaagtttttctgagaaccaaatgagatttatttaaaaatagtgaagacttagaatcaacctaaatgcccatcagtagtagactagattaagaaaatgtatatatacaccatggaatactgtgcagctataaaaaagaatgagatcatgtcctttgcagcaacacagatggagcttggaggtcattatcttaagcaaacttaacacaggaacagaaaaccaaataccatatcttctcacttataagtgggagctaaacattgagtacacgtggacacaagggaacaacaggtactggggcctactcgagggtgaagggtgggaggagggtgaggatcgaaaaactacctttcgggtactatgctcattacgtatgtgataaaatctgtacagcaaaccccatgatacccaatttacttatataacaaacctgcacatgtacccctgaacctaaaataaaagttaaaaaaagtaaaataaaataaaatagctgatgagtgtaaagtgaaaaacaaagatgaaaataatattatttacaaaaatgggtaaggaataaagagacttgataaaaggaagtaaaataggaactttgttttgaaaaataaatgtcagagatttttttctccatttggtgttagttttcatgagctgcatttacagtgaaatctgaattaggtgctgagggaaaaattcaaacatgttaaagaacattttaaatcagattttgaagtgttaaatacagagtgaaaaattcctcttaaaactcaagttttgatgatatgctttttacctgaactggtcctctctaaactgtatttattaaaaatctctgcttgcttatgggtctgttcatttctaaccttcttagatccattttacatgttcttggttatcgctggttgtctgaatagtgttaaaaacattttacagaaaactgtaaggaagaatatttacaataatccaatcctaattacgcagaaacaattagtgctgttgctttggtctttcctgtaataaatgtctttacttaagttgttattctggctttctgacagttcttttgttttactttgttccatatttacctgtcagatgtattttattttctaaacctttgttcaagtaaatggacaaatattctttaaacatcagtattaaaaatttttatttttgatggacagcctcctttaaattatgtgctttctattcacttgtgttacctttatattattttaaatacagaaaataaaagtaaataatttatgaaacatcctctaaatctgcatcttaaaataaagatataaatgagcatattgagtatatagccctttttaaatgtattcctgctcaaatgtaatataaccattttatctgttttatcttaagttgttaattgctcaaggtaaatacttgagaagataagagtttttaggacttattgaattgggatttgtgttttaactgcttagagcacaaatttgtaaatactgtttagaaagattataaaattttgttaaaatgaatagcccagaagtaatttttagtttcattaaggatttattcaaggaaatttagcctgtagatttattgattatagatattatattttacttaattacattcatgtatatgaatagtacttcatttaccttcttagttgacatttcatatcatttactttcacaatttatggcaaaatagtgtagtgggcactgacatgaagtagatccaagttcatcatcctggctttgcttttcaacaaacagtataaacttggacaaattacttcatatctctgatattatttttctttttctgtaaaagtggatccctaccattttttagattattgttgggctgttgtgaagattagaaactgatttagcccaccatctggcatatagtgggagcttaataaatggccactcgagttattttgtgtagcaaaagagcctttggaaatgctaaactcagctagtttctcgctccacagaaaatttcaaggagtgatgctctgcttacttttggtattgagtggcaatgaagaaagatctcatttctaaaatgtgatttaaaaaaaaaaaaaaggattttagtataattcagaatgttctttagattttaatgcaaatttattactgtgcttcattttctgcaagatatgttgaaacattcatgttcaaatgtaatacagaaattaattttgattacccaggaatgtatcatctctattcacatattcaagttcaagtagtaaatacacgtaaagatgtaaaatggggatataaattatgctggagtaggcaaggtacgtattctatcgttcatatggtaagtgttgaaagcatatgaaaagcctgtccagaatggtctcacagacatttaaaacacaactttaaatattacttttactatgtactcagagttagtgtttaaaccttcctgaatcagacattctgggtgacctgaaaattatattggggctcttgagattgaaactgggacatttcagaccaaaaaacaggacaagctttatatgcatttttaaaacaatatggattatattagcatactcaattaaggcaatataaaaggtgaatgttttttcacttttttcttttatttttagttgacacataattgtatatatttatggagtacagagtcatatttcagtacatgtatacagtctgtaatgatcaaatcagggtagttagcatatccgtcatctcaaatatttgtcacttctttagggtgggaacattcaaaatcctcttttccagctttttgaaaatatgcaataaattattggtaattatattcattctacagtgctatagaacactaggattttttcctcccgtctagctgtaattttgtatctattaactaatctctccctatcccctcctctctcctacccttcccaacctctaataaccacaatctactctctacttctatgagctcaatttttttagctttcgcatatgagtgaaaacatgtaatatttatctttctgtgcttgacttatttcacttaacataatatcctttagactcatccatgttgctgtgaattataggatttaattctttttatggctgaatagtattccattgtgtacatataccacgttttcttcatctattcatctgttgattaacatttaggtggattccttatcttggctgttatgaatagtgctgtagtaaacatagagatgctgatatctcttggacataccgatttcctttccattggataaatacctagtagtgggattgctggatcatatgatagttctatttttgtgaaatatacattctgttttccataatggcactacaaatttacattcataccaacagtattttttcatttcctttctgtttaaacaaataatacttttaattcagttcaattatactttatcctttaatttttcttcagccttttactttaattataaagaagcaatatcttttcaaattttccgtataatgctaatatagtaagtcagaagttagatataaaactatcagaaataatacccagataacttgaatactttttttctgaaaaaaaatgtaaaaactaaaaatatattgttttcaaaactgaaggaatgttatatatgtgcacctgtatcttctcaaaggtgtgtgtatgagaatattatcaaaatagatataaatacacatacaagaaattctcattcatgatattaaatacctaatttttggcagctgcatatttctgaaggctcagaatgaagagataagagtgatgacatcattgcatactaatacttagcaaaggactctagaagagtggggcataataacttattattcctgcagctttctgatactggcctggcttgtgagcaaaaacttaaagacttactgtgtatcatattaatatggatgctgaaatagattgttttcataggtttattcttttataaaccaaaactatattgcatgttatcagagtcgccctgccaaagcgcttttaaagatattatcaccatcaataatatcagaaggagaatagatgagggtgtactaaactcatcaattccttttagatagcaaatagtagatcctatttctcagacatcttctttcttcactgtattacattttgaaatttatgaaatgtacatacatgcaaaagaatgcatatatgtatgttatgaagaataataataaatactcatgaatctgccctctaattaaataactacagcattaccaatattgtttcagttacttttgagctcctctcccatttcatcagcttgcctcctcaaggtgtttatcattttatttgttcttaaaatagtttcagatacttctctaaatgtatcatttgattatgcttgtctttgagcttgtaacaatgctgtcactctgtttcttactgttttcaatttatgtatttctgaattcatgcatgttttcctctgtagctgtagttcattcattttcactgcatataatattgaattctgtgcattatgtgcataccccaatatgattatccattcttcttatcatggacatttgggtatatacctacatttaagtgtaattactaggagtgtaattactaggctatacagtttgcatatgctcatctttacagctgtgaatatcatgttctcaaaattttattgcttattatgtcttgtactttcattatctttctactatctgaattactgtatttgagtcctattatgcagttcacctttgaagaggcttttatagttttctcacaaagaccctaagaagaggtaacttttacctttattcctatactacatatagggatacagatgtagaaaggtgggttaggctatttttgatcctcatgagtgataaaataaacttcagaggagagtccctgatatgctaccatttgtgatatactgtgactattctttttaaagaaccaagccaacagtaatagttcatttaagaaaagatttgctgtgacagacttggaagcaggagtagtccccatgctcttctgtgtctccagtgcctggcaaataagtgtttgttgaaagaatgatgtaattatttttcccttaaaagttcaccaaaaatgattacagaaatttagaaactttaggagtttagaatcaagtaaagagctgtttcaaagcactgatgcctgaaccccatactggacccattaaattagactctttgtgatggggtttggcatcagtattatagaagtgatgcctcaagtgattcaaatacgaagccaaagttgatagcaattgtgctatactcatactttagaaggagacaaatatgaggtgggaaaaaatgcatgtaattaagaacagtgtttcccaaaggaaacactggaccatgtttccatggaccatgattcatctaaggaggcatactaaaaatgcagattctttagactttaccacaggctgaatgattgagaagtgtggatcaggaggttcaattatttataggtgataacagcccagagcctatacatttataaaggagtctggttagttttcaatttataactgtagttattagtgggttatagtccctctgtagtaaatacatatccaaaaggattaggcgtgttctatgaaacatcaaatataagttattaaataaaaagtggttattgcacacttgtaataagaaagagagaaccaatgctagaaagtggtgtggtggtagtagacaggggaaggcactaaggttagtaaaacaagaagcaataataatcattagtaatgttttaagcatttattatatcatattgtaccatacatgaattacatgacatagattttcatacctacacaagatgaaagcagcaaaccaaataaattatagttactattaggttggtgcaaaagtaatcatagtttttgccattacttttaatgcttattatgtcttgtactttcattatcttcctcctctctgaattaccatttttgtcatatgtcataatattaatattacttttaatggcaaaaaacacgaatacttttgcaccaacctaatagttataggcactgatttattaaggcatttcgcttctgctgaagaagtagtttttaacatcccagtctgcttaggttgggtcagaatgaccaccaacatcagataggtaattcaaataaaattaggccctaacacaagtaaaataatggattgaaattgtaaatgacagcggcaggttgaagaactggtcagaatcaagtaattaggacaagtgagcacaaatcaaacttataaaataagtcaaaatttatctgttaaaaccagattgggccaggcgcgttggctcatgcctgtaatcccagcactttgggaggccagggcgggcagatcacctgaggtcaggagtcaagatcagcctggccaacatggtgaaaccctgtctctactaaaattacaaaaattagccaggcatggtggttcatgcctgtaatctcagctactcagtacactgaggcaggagaatcacttgaacccaggaggcggaggttgcagcgagccgagatcacaccactgcactccagcctgggcagcagagtgagactccgtctcaaaaaaaaaaaaaaaaaaagccagattggaaaagactagatttgcaaggaggtagcagaatgtaaccttaggttgactgtgggtaacagtatgtgaggcttgacatagcaccgctaaaaaaaaacactaataacccatgaaatgaagagatacagcctggaaaattaacgaaatggttattgcattaaaatctgcattggttaggtcttcatatgcacatctgtcttatgtttcccttctattggtgcagagttgtattagtcaaggtatactagattatgctgcagtgacaaacaacctgaaaatattagtggcttttaataatgctcatatcaaatgcccatgctccatgtgcatcctgggttgctatagctttactctatgtcctattcacttcaaagcccaggctgatagagtagtctcttctagaaaattgctggtcatcatggcagaggaaaaagagaacatggtgaaccatgcattggctcttaaagcttctgcataaaaatgagacctaacacatctactcacaattcactggtcaaaacaagtcatatagccatgactgacttcaatggctcaaggaagtttacttttccctttaaaaaatggcaggtatatatttggaaatcataatacagtctgccacagcaatcaatctatgaagaattccagtataacattatactagaattttgaggacaacaatattttttatttgaatgtaacctctctctcctcaatactgaagtgtgtttgtactgtgtgtgtgtgtgtgtgtgagacacagagagaaagaggatcagtcggtattttaagtgtaatctgctggaatatgactggtaggtttcagtgggggacaataaatgaccttttggattttgtccaagcacaaaattctggttaataatcacttggtactcggcgttagtactaggaaacttaaacagatatggattctatggaatatctcttttcaaggtgtaccaaattaagcctagatttaagatagtactattacttggacaatttagtatttattaggatttttatatcttgtcatcatcaatgatctaaaactattttttgcatacgcggacataactggcgctttttcaaatactgcacacaattactgaaaagaaatgattccattttttacaagaaaatgcaatctaaatagataaaagagacaaacgtatagggcctgaggaattgtttaaactgacagtagaaattatataccataccatctctattttatgacagccaagtgaataatcttgaattaaagaattaatgttgaatttatatttttatttatgatagtatttgattttagttttgctttgcaccctttatttgagtttattacaagggaaaaaatgcctcccattgcttagaccctatagagtttcctttccttgggatatagtagatggtcattaccataagcaacttgaatatctggaagctagagagactttctattacaaagaaatgttagcctcattctatgactataaagttcttgctatcttttctgtaatacaaatcttgcagtaaaggctcaactatttttgttaaatatatcttctgagatcaagcagattgaagtttaaaaccaaactcacatacaaaatgttttaaaaactgtgaaactcagtctatttttgtataaaatagaagtgtgaagaaactaagtgtactgtactagctttgcaattagaaattttattttcaacaatatggctttatgagttgcatttttatactcatatgtaaaatcaatgtgtaatatttattacagaaagtgaaaatagagaatcagtgcaataaaatattgataacagataaattcagattatagagtgtacagagaaccttgagaaagtaaagagacattgaagttgaatatggggttccttctctgaaaatattaacaatctaatgggaaagactaagactagcaaataaataactgatgaaaacataaaatatctagaactagaaataccatttgacccagccatcccattactgggtatatatccaaaggactataaatcatgctgctataaagacacatgcacacctatgtttattgcggcactattcacaatagcaaagacttggagccaacccaaatgcctaacaatgatagactggattaagaaaatgtggcacatatacaccatggaccactatgcagccataaaaaatgatgagttcatgtcctttgtagggacatggatgaaattggaaatcatcattctcagtaaactatcgcaaggacaaaaaaccaaacaccgcatgttctcactcataggtgggaattgaacagtgagaacacgtggacacaggaaggggaacatcacactctggggactgttgtggggtggggggaggggggagggatagcattaggagatatacctaatgctaaatgacgagttaatgggtgcagcacatcagcatggcacatgtatacgtatgtaactaacctgcacattgtgcacgtgtaccctaaaacttaaagtataataataataaaataaaataaaaagaaagcataaaatatgtaaagctagtagagttatctggtagaccattcaaaaccatttaggccttgtctcatgacatgcaaaataaacaaacttagttcataatgggaattaactcactgcctcttcaggctgtcaaaacacagctattaaagttacaagacagctattaaagttacagggattacagtctcaatctaatgaatgaatgaatgaatgcatgaatttatttattttccccaagatggagtctcactctgtcacccaggctggagtgcagtggcgcaatctcggctcactgcaaccttcacctcccaggttcaagcaattctcctgcctcagcctcccaagtagctgggattacaggggtgcgccaccatgctcggctaattttttgtgtgtttttagtagagacggagtttcaccatgttgaccaggttggtctcgaactcctgacctcatgatctgcctgcgtaggcctcccaaagtagtgggattacaggcatgagccaccatgcctggcccactctaaatgaattttctaatcgttgataaccttgacatttttacttcagtcttgaaattttgatttttttggtttgttaaagacccatatgaatgctgaaaaaacaattagcctttcttttgcctgtaccctcacgtctctatatgctaaaaaattattttacacactcattcaattattggggcgttagtttttcattgtgaagtaaaagactagagtagttggagctaactttagatgaccttgtgggagagaactggaatagaattttgtagaggaatattatgcaagatgtggaagaattggccgtgttcactgacagaagaacaaagtagttctcagccattttacaagcatgacttattttattttattttattttattttattttattttattttattttattttattttattttattttgcagaccccatgtgttaaaaaaaatttaaggcttttgaactacatttctataataataataatttccctaatttttaattaatgatgtgtaaccactagtcagcaggagacaaccagtgttaccaaagtcagtttgtgcaatatatggtttctcttgccctttttgaattacccatagtggttctcaggccacactcctccagagttatctctatatactatcctggaaaatatgagtaataatatcttcatcttttattttataatttggaaaaaattaaatgacagaaagaaatggagaataatgtaagaagcagacatggaccaacacttcaaattgataaatattaagatatggtcatatttgcatcagaacttttttataaagttgtttgtatttctgctcaggccccttcctcagaggcatgcatgagcattggcatgtatccttttggttgatatttatatactttgctatacatatatgcagaaacaatatattttacttctcaattttagtcaacaatgaaacatcatggagtttaaacagaaggatgtgggattatgataggataattaaagtggttcagaagtttgatatagtagtcatatcagaccctgcttgaaactccttgatggcttgctcattagcctcaggataaaactcatattatttaacagactttcaaggcaacacattattagatttccaaagttttccctcttcagttcatctctccatatttctctttcatatctcatgcccttgttgctctgtatgcctcagccataggaccttttaagtttttaaaattttcagtctctaaagctgtattagtccattcttgcataggtttaaagagctacctgagtctgggtaatttataaagaaaagaggtttaattgactcaaagttctgcaggctgtacaggaagcatggctgggagacctcaggaaactcacaatcatggcagaaggtgaaagggaagcaggcacatcttacatggccagagaaggacaaagagagagcaagggggaggtactacatacctttcaacaaccagatctcgtgagaactcactcactatcacaagaacagcaagggggaaacacacctccatgatttaatcacatcccaccaggcacctcctccaacactggggatcacaatttgacatgagttttgggtggggacacaagtccaaaccatatccaaagcctttccacatatttgttttgcccagtacaattcttccaactttagttcctctcatccttccaacctcaatttacacatcacttcctctgggaagttcctctgatccttccaaaatatgacaccagagcccaattaagacattttagaagcctcaaatactaaaagtcatataggttatatgactgttgccctaccaccatattattcacaataaacacaatattaagtgcaatgaagtctgaaatttcggtttcctaatagtgactattttgatgattttattctttgaggtattgagtatcatgttatttgacaaaatcaagttacttgtttgcttactgcacagcagtctgttcttaacccatcatggtgcttattaaataatcttattgtttttctgcacattttactagactgtaaacaatttgacggtaggaattatgtattgttcaacatcctatccccagaacaaggacaatgcctggaacatggatattgatcaataaatatttgttaaatgaaaaaatcaatgttaacctagtttctcatggtttacaattacttattcaaaagccttgccttctctaagtttattcttagagatgagcaattccgacctaaaaggacgtgaagatcaagttattcctgtgtgtcgcactcactgtataacagagtggatcttcagatgagggaaaacatgaatataaactatgtctaaaggtacatctgtttgtataatattttacaatttatgaagtattttcaaatataccatctcatttggtctttataatacacttgggaggcagatatttttgtctaagtttcagatataaggtagcaggctgggacaggttaaatgacctgcaaagttatgtggcagtaaggcaggactagaactcaagtccacatcttttgactctaaataacctctctatatggaaacctgtggatcagtttatctatggctatagagcaatatagttctttctgtcactgaaaattcctaacctgaatgcttattcatgatgatcaaagtaaagcaatagtgcaattagaatatatcttccaactgactggtaaatcaatggattttatatttcaaaggaaaaaaagtaatcttagtatttttctctcttacatatcttctagagcctttacaaacctgagagtgtctatatactcattcttactactttctgagtttttggcatcgataatgttctaggtttttatagtgagataaaagtgttaaagtattggatttgagtctcagaaaacatgaaaatccaactatttttattttattattaaacaaacatattaatgattttatgtgacatttttgcataaagcttctacagagtcttctttctatggtttcagtatgtaaccaataagtcatttttatgtaaagatgtttgctttacccaagagattgtaaatgaaacttttatacccaaagccattctgtaatgaagattaccttatgtaacagattgaatgaaagcaagtcagaaataaatctttgtagaaaaccttattgacaaaattctccctcattcttttttaatccccttaaatcatattgccaccagagagattgatgtcagtggcatatttgatcataacactcttctgcttataccccttcaggggtacccccttagtgtacaagataaattttaagttctttcaaaatggtcaagtaccagcctatttcatcagcctcatttcacttcttcttgctttacaattcatattctagtaagaacaaactatgtttagctccctgcataaatctggttctcagccctatgcctttttaatcatgctattccccttgtcttgactattcctcagcttttatctggataactcctgtttattcctccagattctactcatgcttctctttaaaataaatgcctttctcagactgcttacctaggtggtagtctttccttccttaacaccctctactcatgtctttctttacagctactaatttatatttttccagctctattgaggtgtgattgacacattaaaattgtacatatttaagacatacaacatgatgctttgatgtatgtacacattatgaaataattaccacaaacaagctaattaacatattcatcacctcacatagtttcctgtgtatgtgtgtgtgtctctgtgaggtaagagcacttgaaatctactctcttagcaaatgtcaagcatgcaatacattattattgactactgtcaccatgctgtacattaggtctccagaactattcatcttatgactgaaagtttgtgccctttgaccattatctcctcccaccctgtccattgtaaccaccattctactctctgttactgtgagtttgacttcgttttttagatttcatatataaatgagatcacacagtatttgtctttctatgtctggcttatttcatttagcatgatgtcctcttggttcatccatgttgttgcaagtgggagaatatccttctttttaaaggaagattaatatttcattgtgtgtgtgtatgtgtgtatcacattttctgtatccattcatcttatgtagtacacttagattgtttctatatcttggctactgtgagtaatgctgcaatgggaaaccagacatcttttcaatatagtgattttatttcccttggatatatactcagaagtgggattgctggataatatagtcgttctatttttaatttttttgagaaacctccatactgttttccatagtgactgtaccaatttacgtttccaccaacagcagacaagaattctcttctctacgtttttgccattacttcttatcttttgacattttgattatagccattctaacaggagtgagatgatatctcattgtggttttgctttgcatttttctgataattagcaattttgaacattttttcatatacctaatggccatttgtatgttgtttttgggaaaatatctagtcaggtcctttgcccagtttttaatcaggttatttgtttctatttttgctgttgagttgtgtgggttccttacatattttggatattaaccccttattggatacatggtttgcaaatattttctcccattctgtaggttgccttttcattttgttgattctttcttttgctgtgcagaaactttttgggttgatgtagtcctgcttgtttatttttgcttttattgcctgtgactacaaatttatattgtactatatacacatttttgcgatttttctttcctgctaccctttgagctctttgcatcttctttccttgggaattttatttcggtatttttctacccttgtatcttttggatggtctgtgcatatttttctctagaccactaagtaaaataacatataacttggcataatctattggtaagaagtcaataatcaataaacaccatgccaagaatagaacatttcattattcttttgtagttaggtaagacgcattgatattttttgttaaacatcattgtatgatacatcatgatattgattaatgtattttagcgattcaagcacataacgcatttcaaaggtaatgataatctgtaaatgtgtgcagatacaagtataccagtgtatgtggtaggtggaaaattactacagttgtgggtatggagacactgcaagtacagaattatggaatcagggccttgttcacttggaaggaaacttaggagtcatcttaattcagctgcttttgaaatttgtgtgtggatcatgataataacagctaacatttgcatgttttgtaatttacaaaacatttccatatcacttgatgttcataggcagttcaacagagttgttattgttatgatgctcttgacaactctacaaagagaattggtttcattgtactgtgctgctattgtagatttcataatagactggaatctgctgtttgctgaaggaataagaagggatacatcttgttagtacaactgaatccctccatgttttcttccagatgtggcctttactgttatttgtttggaatttttgttaaatggcttcctgttttgtaactgttgggtggactgtagtatatttctctagacctgcactgcatctaacaccacagtaaccactagctgcatttggatattgaaatgtaaatttaaatcaattaaaattaagtaaattcgattcctcatttgcatgagccacatttcaagtgctcaataaccacgtgtttctaatggttatcaaattgaacagaatagacaaagaacatttttgttatcccagaaagttttattggacagtgctactctagaccattgctatatgtatgcatcttgatgaagttgtcatctgtcagtagttaagctgggatgctgtaaggcagaaatctgtaaaagtaatcagactgacaataagtggtaaatggatgaggattgttctagcttattactaaaaatggaatagtccctctcccctatggaaaagttgttagaaacttttttgaatgtaaaagactgtaaaatgacttaaaactagtgaaaaactgaagttttgctttcttttttaacttttaagatcagaggtacaagttaacatttgtcacatagtgtatgtgtcatgggggtttgttgtatagattatttcgtcacccgggtattaagcctagtacccattagttattttttctttttctctccctcttcccaccctccaccttccaataggccccagtttctgttattcccctctatgtgtccatgtgttctcatcatttagctcccacttaaagtaaaaacatgtggtatttggttttctgttcctgtgttagttttctttttacaaaataaattttgcttttgttgttcttcagctcattgtggccaatactatatcacagtatctttttcctctgaggaataagcagctcatgtcaacattttctactcctgacaatattcttcatcctttttttttttttttttttttgagacggaattttgctgttgtccaccaggctggagtgcagtgtcacaatctcagctcactgcaatgcccgcctcctgggttcaagtgattctcctgcctcagcctcccaagtagctgggattacaggtgtgcactaccaccacccggctactttttgtatttttggtagagacagggtttcaccatgttggccaagctggtctcgaacttctgacctcaagtgattcacccgcctcggcctcccagagtgctgggattacaggcgtgagccaccaagccaggctatccttaagcttcaccagatttgtgcctccttgcccctggttgataaatttgccacatttgttatactgttttaagaagatggaaagtattagatatattcttgattcatttatttttccctttaatatcacacttcagtcagctagtctcctttcttcatatttgtcatgtcaactcctccaatgatgcgttctgcttggtgtgtatatagtactagatcttccatctcctaatacactctcccaacaaaaatgacaagaatcatgttatatagagcatacttatatattctttgcatttataatctttacatcagctgagttatataaatatgtttatctggatttttgtaaattactgtatcatgataaatgctaaactgcctatcttctttttttcatcactttgaccctgcttctcaaaaaactatgcttatagttcctttcctactttgaaatatttcttagaagaccagtttatataagtactcttacttgtacatctaaactcctcacattgtctttttcaactactccatctccattattaaattaaaactgatttttaaagcttcttgctgtcatttttctctgactcttacttaaattagacactgtttttcccttctccctttccaaaactcttttcttgtctctgtaatatcactttcttcatttaatcctggccatgggattaattcttgctctggctcctaaacaagcattgtctgaggttttatcctcagccgtcttcccaccatacatactctgttctggtgaagtcatcattgttgttttcttgtagctttaactatcccttcaatgtcagtatcttcaagatctggctctgtttccattctaattcagttttatcaaatgcttgccagacaattgtatgtaacacgttctgttttcagccgcttctaattttatgtgcacaaaataaaattgttttaatctcctcgatttcctttctccatctctactataccattcatccatccatttcctcaggcttgaacacttagagtaatgtttaacttttccttctccattatttcttgtttattaatttgcatatttcaaattttttgtggatacgtagtaagcatatatattatggaatacatgagatgtttgatgcaggcatgcaatgtattcataatcacatcatggaaaatgaggtatgcatcccctcaagaatttatctttcatgctataatccaattatactttttaagttatttttaagtgtacaattaaattattattgactatagtcacactgttgtgctatcaaatactagatcttattaattgtttctaactgtatattttttgtacccatccccacttctcctccacccccactgctatatttcccagcctctggtaaccatctttctactctctatcttcataggctcaattattttgatttttagatcctgcaaatgagtgagaacctgcagtgcttgtctttaggtgcctggcctgtttcacttaacataatgatctctagatccatagatgctgttgcaaatgactgaatctcatttttaatggctgaatagtactccattgtactacattttctttatccatttatctgttggtagacacaggttgcttcaaaatcttggctattgtgaacagagctgcaaaaaacatgaaagtgcagatatctttttaatatcctgatttcctttccttgggtatatacccagaagttggattgctggattatgtcacagctgtatttttagttttttaaggaacctccaaactgtactccatcgtgattgtactaatatacattcccaccaacagcgtacaaggttcccttttctccacatcctcaccagcatttgttattgtctgtcttttggatataagccattttaactggggtgagatgctatgtcattttagttttgctttacatttttttgatgatcaatgatgttgaatacctttgcatatgcctgatggccatttgtatgtcttcttttgaaaactgtctattcaaatcttttgcccattttttaatcagattattagatttttttttctatagcattgtttgagctccttacagattctggttattaattgcttgtcagatgggtagtttgcaaatattttctcccatgttgtggcttgtctcttcactttgttgattgtttcctttgctgtacagaagctttttaacttgatgtgatcccatttgtccatttttgctttggttgcatgtgattgtggggtaatactcaagaaatctttcccaagaccaatgtcatggagagtttccacaatgtttcctggcagtagtttcataggttgaggtcttagatttaagtctttaatccatttttatttgaattttgtatatggcgggagatacaggtctagtttcattctaatgcccatggatatccagttttcccagcaccatttattagagagactgtactttctgcagtgtatatccttggcacctttgttgaaaatgagttcactgtaggtgtgtggatttgtttctgggttgtctgctctgtttttactggactctgtgtctgtttttatgccagtaccatgctgttttaaatactctatctcagtagtataatttcaagtcaggtgttgtgattcctccagttgtgttctttttgcttaggatagctttggctattcttttgtggttccgtatacattttaggattttttttctattttttctatttctgtgaagaatgtcattggtattttgatagggattgcattgaatctgtagattgcttaggtagtgtggacattttcagaatattgattaatccaagaacaagcaatatcttttcattttttggtggcttcttccatttcttttatcagtgttttgtagtttccattacagagatctttcacttctttgattatgttaatttctagatatttaattttatttgtggctattgaaaatgggattatttttgttttctttttcaaatttttcaccgttggtatgtagaaatgctactgatttttgtatgttgattttatatcctgtatgtttgactaaacttgatcatcaattctaatagttttttcttggagtctttagatttttcccaatttaagatcattatcatctgcaagcagtggtaatttgacttcttccttcccaatttggatacactttatttatttctgttgcctaattgctctggctaggacttccagtactatgttgaatagcagtggtgaaagtgggcatccttgtgttctagatcatagaagaaaggctttcagttcttcccgattatgatattagctgtgagtctatcatacatggcttttattatgttgaggtatctttcttctatacccagtatttttttttttttttttgagacagactctcactctgtcgcccaggttggagtacggtgacgtgatctcagctcactgcaacctctgcctcctgggttcaagtgattctcctgcctcaccctcccaagtagctgggactacaggggcgtgccaccacacccggctaattttttagtagagatggggtttcactggtgttagccaggatggtctcgatctcctgaccttgtgatccgcccgcctcggcctcccaaagtgctgagattacaggcatgagccaccgagtccggctctatacccagtcttttgagggtttttattatgaagggatgttgaattgtatcaaattctttttcagcatcaattgaaatgatcctttgatttttgcccatcattcttttggtatgatgtatcacactgactgatttttgtatgttgaaccatccttgcaacccaggaataaatgacacttggtcatgatgaatgaccttattaatatattgtggaatttggtttgctagtattttgttgaggatttttacatcagtattcatcagatattggcctgtagttttctttctttggtgtgtctttgtctggttttggtaccagggtaatattggccttgtagaataagtttgagtgctccctcccctgccccctctattttttggcatagattgagtaggattggtatttgttctttaatgtttggtagaattcagcagtgaagccattatgtccccagctttcctttttgggagactttttattatggcttcgatctcattgcttgttattggcctcctcaggttttagatttcttcatggttaaattttggcaggttgtgtgtgtctaggaatttatctatgattttccaatttattgccatggatggatatcgctgctgctagttattcagggcccaagagcttttcagttagcaggtgatgcatgctacctggactgggtccttccccttaaggcaacaggttcccttttgacccagagtgcatctagaaatgtctatcaggagctagggcctggaaagggggcctgaggactctgactggtaccctatcctgctgtggctgagctggtatcccaagacgcaaacaaagtcttccccactcttccatttcctctccccaagtgaaaggaaggggccttctttggagccacgagctatgcaacctggggttaggggagggttgatgccggtgctcccttagccatcccagctggtatctcagtaagttgtgtgccgcccccctagtccactgtctctgggcccagcttagcactaggacttgcctaagagttgctgtccttgtggcctagacggcttttgcagtttatttggggccccacatcgctgtagcccatggtggcgaagcttgtggaaactcaagttcagatggctgggattggtgattgattcccctctggttaggactcgtttaaatgctccctccatgggtgaacatcagctgaatttggttcagttttgttttctgctataacaacgtcagagctgagtttaatgcctcagaattactggctttctttctccccagtgcacagaaacactctcatcatcaggcagctgctgcccaggtttgggggaaagggggcattggcaattgaagactgtttttcctacctcttctgtgcctctttcaatgatatgaagttaaaactaggtattgtgagtactcacctgatttttggttcttatggagatgtttttttctgtggagatagttgttaaatcggctggggggacaatccctcctccaccctttctagagataaaacatccactttagtatgtctaggaagatacacaactttgcggagattcccataactgagatatggcacaaaaattactcttaaggggctatgaagaatggaacaagagatgactatgggagttgttagctggacaagaacatttcatctctacagacccctcaaccctcactcacaactcacattgctgtatatcatcaactattatattagataggctgccttgacttcaactcttccccaaggaaagtcaagagaaattataaactgactgagttaagtttttgaaagagattcaaaatggaaattaaattgttatagaaaaattgaaattgcttttcttttaaaacaaaaacaaaaattttcttcaacctaacattggtagctctccataatatgccccatattattttctctgccttctttcccactgcattttccccacatagcttaaattttaaccaaatcagtctgcttacttcttattgactgtgcatttgttcagtgtgttcacacactttgaaatgttctttctccctaaaccttcaaattccagatttgaaagccatttagggccaggtaaaatatcatttccttcacttagttaatccaggattatcagaatttatctcctttttaatgggatcttttgttagaatttatcttatctaccttctatttgtatttgaatgttttctcccctcctacttaatgaaattgtgatggccaaataccaagggtaatttatccctcattacataatagtatctggaactgaattgcatttagatgacaaaaaacatgttggtgaactgaattgtgacttcaataaataaatgaatgcaaggaagagaggaaggcagggagggaggagaaaaaaaaggaaaggaaaagtataatattcattgcttaaattaaccccttaggcatgtaaagacattttgataataatagaatatgttgaagtgttgagtatgaaggtaccattatcaaaggtttacatagatggattatttatatattacttctaagtaaaacaatatttttatattatttgtaaaagtatacaatatatacacaaaaataagacatatggaaatttatggcatttataaagttccatgaaatataatagtattattattagagatatacactatttcccttcactatctctctttatatatttactattaataacatatgcactgttcttatgattataatatacaattgatgagaaatattacttgttctgagcattgtgacccaccaggcgcttaaaacttgttgacaaagtatggagcatcagtggtaatatgtaggagtaaaaattgttctgttattctgctcagtatagcaattgcatcattgtttcacagaaaggataacattatgatcctgtgtgggtgtatagctcatctgtgggaggatgtttctgtgcatacttagtgatcaaaattcaagaaacacgcctcatttttatgaatattttctcattaggaatttggctcatgtaaatgcatcacataatttgtagaagcattatatggaaaaggaaaaagaagaaatgaattttttttgcatatacaataaaagcttgagctactgaagagaattcctggtagtatatagtatcgtgactggaaacccagtctttaaaaactaaatttaattctaacctaaaaataactggaatgtcagaggtgtacctttccacagcatgaataggtttgtaaagtatagatttatccatatgcaatgctattttctctttaaaacttgagatatcttttgggaaaggatttggccccaagtattaataaaacccatactttagaagcaagtattttaaaatcacctgttgatggaagtaaaataacttagtaataaataaacccccccaaagtacctagagctatttaaatacttaacatgatgaaatgaatgccataaaattacagcttaacaaaatataacatagtcatttagtttctattcttctccctaatataaagtagcaggttaatatgcattctctctgtttggttttgttgttcttttttttgttttgaggcagagtctcactctgtcacccaggctggagtgcagtggtgcaatcttggctcactgcaacctctacctcccagattcaagcgattctcctacctcagccttccgagtagctgggattacaggcatgtgccaccacacccagctaatttttgtatttttagtagagacggggtttcaccatgttggccaggctggtcttgaactcctgtcctcaagcgatccgcccacctaggcctcccaaagtgctaggattataggcatgaaccactgtgcctggcttctatttttaatatgctgcatcctcaccctttgtggaaagcctctgggtttcaataactagcaagccgatcttgctgaaagaaggtagagatacaaacaagtagaagcaactgttccacataaagaaagaaataagtttaatgggaaaaaataatgaattgggggaacgtgcaatcaaaatacaattctgaggatctcagaactatttggagtgagctggcagataatgttataaaaagcaggttaccagtttatggattctatatatttgataattttgggatagctttggtgttcctgtatcacatggtaatcctataaaatagatcaagtgtttctcgaaataccatctttataaatatcatcttggaggcctcactctgaatcaactagatccgtacttctgggaatctgcattttaacccacccctcaaatgattcttatatatgcagaagtaaaatctgaaaattactatagtagcttaactgagtgtggttacattgcttttgtgatgatgccattattttctctttctaaagacccactgtttccaagacccagttaaaagccacctttcttgatttgttttaacacagagtttagtttcttcctcctctgctcctctagctcccataattgtgcctttgttacactaatcaagagtatcccaaatctcttaatgcagatttaaactttaataactttacatacgtaagtgctacaaccttaccaaaaacattatttaaaatttatttaaatttattttacaatcatttagttttgtttattttaaatagtaagttcttaattttaatatttatatgtggcatttttttggactggtagaaaaacttgaccacctcaatcacctcatatatctcccttaaactttcttttgcagggtcatgtcaaaatagttgagtgtgcaccaatattttattcttcaaataatcttaaatctaggatcacagatgtcatcctttctgtcactaacccacagctggtagaagtttttgaaaagtttgaaatttgactagagcaatgtatagtacaacccagtatactatatgttgaattttatttcctgttgaatgttaataaaaatatattaatatcttaaaattttaaataattggccttttatctattgatttgtgtaatggtgtatcatttatacttctaaagttaaaaatacttaaaacagcatgaatactttgaaattctgtgttttaacttatttgtgtgaattcctatctccctaaacagcacttctctaagtcaggggccatgttttattcatccttttgtctctagtacagttgattaatatttgctgaatcaaggggaaaaatatgtctattttatattgtctaattaatttagtatattcaatattatttaaatattactaactatatttagatataggtagcacatttaaaatgtaatattaatatagcatcaaacatatatttaatagtatttgttgtgtttccatccattgcagttattatccttttagatgctcaaattgttccatgtttgactagggggaatctcttcatgttgagtcctgagtcctactaaaacaggagccaactcctgtgtagtggtagtcttgacagattactcctagtagtctttgataacttccttctgtcttgtatcacagtataatccaagctcatcttgtacgtttcctattccagatctcaaatcagccattttccaagaaggcttggaaatgtggttttaagaccataaagtctgggaagtgtatcattactaggttggtcattgttcctatgccttttcagggtgcagtgctaataaatacatgcatacatgtatatacatatgtacatagataatacttcaagagactccagcatattatttaacttcttcaatcttatatatgtgtctgctttatcccatgctaaaaatacttatcaatgacactggagtgatagaatggcagtcacataattgttcagttattcatcttataaagcacacacagcagattctgcatgacaataataatcacaacactaccatctaacatcatatgattactgaaaacagtttaagattattttaacagttctttttgttggatcacattaggaatgtgctagtaaatttttatattttaaagatacttgaaatagttactttccgtatgattattatccactactagagtatacattcagatcatgtttactttgtttacttttttccttgaggagaatccctttgaagtttgaatttttagtcataccctctgattctgggaaggtaggcaaataatggaatttgcatacattgcagctgaagcaagctgtagaagcagcatgtggaagctgggcaagttcccaacttttcccagattatctctcctttggcatatgagtccctcagaaagacaagacccaattcttaagtatttctgtgaattttgtaaaatatacttaagttttatttttaaaactttgccccgatctgcatatgtatttcttctgacaaggcattgtggtgaagttgcattatcaaaaattgtgttgaacaacattccttttttgttaaaattaaattcaggaaaaaatgaaatggagtatcatttcttaaaatattcagtactgtggaaatgggtttgttttttttttcaaaattatccaaataataattaattttattttttgaagtaaagttagttttttaaagttaaaatagcaatggccaggcgcagtggctcacgcctgtaatcccagcactttgatctgccgaggcgggcagatcatctgaggttgggagtttgagaccagcctgaccaacatggagaaaccccatctctactaaaaatatgaaaaattagccgggcatggtggcacatgcctgtaatcccagctactagggaggctgaggcaggagaatcacttgaacccagggggtggaggttgcagtgagccgagatcacaccactgcactccagcctgggcaacaagagcaaaactgtctcaaaaaaagtaaataaataaaatagtgacattaatacatggttaaaatgtatttatcacttaatgtatgtcagattctaatgacttatctcattttgtcacttaattctcacagcatttttattgggttgctaccagtatgcccgttttataaattttgtgaggaaactgcgccatagaaacattgtctctaagcaaagatcagtttgttgtattactgcttattgtatatcaagtaattgcaggttaaaagaaaagaccatggtggtttttgaaagaattttttgtaatttctgggacttaaatttaggtgagaactatgaacttggtaattattattagtagatgtattaattttaagtgtgtactgtaaagtatatttaatagcttgcaatagttgaaaatataaaagtatttgagattttgataggactattgaaataaatgttagtgtgttttttaatgttctaatctataataaattagtatttgaaatgttagggacatttcaacagaatacatttatcacgtgtaaaagcttagatagaaaatggttacaatattttttcaatatttgtttttaaaagtctacttaatgtatattgtcctttagtatgtgtttaaaagaagtaaagttagaatatacagttaagcaaaaataaggatagcctctgttactgaccatcagagctaaccattattaatattttggtatgtagcatcctagatttttcctgttattattgcttttacttgaattgttaagacttttaaaattatagtataatttctaagaaaatatttttaaaagaatgcttgatattttgaatctaatgtatatggttcttttttttcaggattgtactgtatatgaaacagagaataaaattcttcacgtggtgagtatacttggatttattttaatctttattagaggatatttccttgttcaactagaagaggtgaaccataagaaaaaaaatctactgaccacatcagttaagtgtatttttataggaaatctacaaaacaatcaaagcataacaagttacgttagttataaccattctattgtacctaataggagaaaaaaggtataatattttaaaattgtaatgtgtagcaaggttggaatataataaaaaattaataatgtagagcaaggagaatttgaaatgagaatttcttttactgttcatctattacaaaaaagatcagagaaaggtattctgttctataatgggtaattcatctctatcatcatttggatgaaatactttattaaaaaaatcaaatttcctttgctccaattctatacctacgagacaacctttcaaatggtaatatggcaatatttttgaatcagttaatgactttacatatattttattactagaaatgggctacgcgtacattatactttgtggaaaggccatctcctgccttcttaatgaacagttggccacttttatttgtaaatgcatttcttgatcaatgctagtttgtcctaataacttcttcacctctggtgtgtgtgaaatcatgtcatttctgcatctgccaggtactaggcggtgaagatccatatgtctgtaaaaggacatttgcctcatttattcctaatatcagtctattaagttttatgtttctgaaatgtttgaatatttataaaagaatactattttgtatttagaaaaggaaatacttttaaaacatctaaacgtatggagggaaaatattacttcagaatatcagcagtacagcatccctattccttttttgttatctgttatagaaatgatactgaataatcctctgctaatcctctccccctcattgtgcagtagtgatgccctttgtggtttataagaatagtctcaggagtggataattaatttacttttctccttattagtccaggagggaaaataattacaactccctcacgttgatctacctgtagggcctggagaatagaaagacactaatatttatttagggcctatatatttcaagtattagcttaatttcttataagcatattctctcatttaatcctacttttgcagatggtggaactaagggtcacaaatattaagttgttcaactattcggtttgaacacagaatctaataccaaagcccatgccctttccagatctggcagttgctaccaattctagctccctgaggctttacaaattgtactatcttttttcccgtggaacccagggctactgtctagctgtgcctattttgtcaataactaaggagcatgcacagaccctttcccacctacattttattttctgtgagtgactgtttctttagcattgaattttctatgacaatgactgttctttctgaagtattgaatttactgaattcgactttggtatgctgctgtgggttcttcattgtgtttacttcaaggctgttattgaggtcagtgtgtgttaacatttttttctttatcaagtttctcaggagtaatctccctgatgttagtatcaaaaagagctgtacttttcttcatgcattggctgctacgaacttaagattaaaatttgtggcccataattgacaagtgcatctcatggtatttgttttgtatttagcttcattcttggctctacatgatttctttttgccttgtttttctcaatttatgtatggtatatatttttacatctgttgatgtagccttttctatggaggaatagttccagttacaaatgcacatttgtgatcaatattcaaatatcaacaaaggaaatgtaaataatttatggaaaaagaatctctagagaactgtaaaaaatatgaaattttatttctgaggaaatttcagattctaccatatgacagaataacagaaatagatttaaatgatgaaagaaatactgtgggatttctcttgtacaaaagactttaaatataattttaattaattagactaaggaaataatctctttggggttataaaatgatgaatgaaattttattaaataaaaaccataataagtaatagccaaattttaaaagttcttaatcactaaatatttttaattttaaataattttaaaataataagtaatttttagtttcttaaataaattcctaataattgactcatattgactttatctttctcaaaagccagattctgggctacttgctattagaaataagtaacagcataaatagtactgaaggagtttagaaatgaatgccgtatatttaccttggcaattttgcattccagctagtgagaatttaaaaatcctgtctgatgatgatgacaacagtgaatggcattaaccaaatcagttcatctcagaaagcacttgtcttttcatgttattcttctacttcccatcctgacgtttttatacaaagattacccagcctttaccaaaaggttgtatgtatacttgtatattacttttttcacaagaataattttttagaataataaaatagtatacagtaccacttagtatatgaggctagaatagtttctttaaaacaaaatttctagaataagtatctttctagatctctatagtgtagaagaaataactttgagtctaaaaaactgtctgaatcctaattctaccattttctatctcggtgagctgaatcaagtgatgtttttgagagtttgttcttattatgtaaaatggggatattaatatctttcatgaatgattgttgctaggataaaataaatcagtaagttttctagacagagctttataatctggtagttctctttccagtatttattttttaggttatatctcattatttaggttttttgttgttgttggtttggtttttttttttttttttttgagacagagtctcgctctgtcacccaggctggagtacagtagtgcgatcttggctcactgcaagctccatctcccgggttcacgccattcccctgcctcagcctcccgagtagctgggactacaggtgcccaccaccacgcccggctaattttttttgtattttttagtagagacggggtttcaccgtgttagccaggatggtctcaatctcctgacctcgtgatccacccacctcggcctcccaaagtgctgggattacaggagtgagccactgtgcctggcctatttagggtttttaatatcttctttctctcctttttatatggaccagtaaatcaaaagccagagtttttatatagcttgtttaggatgcaattgtgagttagttttaatgttttccttgtttctatgatacttgaatattctaagtacaatatgatttataatggctccttttcaaagatgaattaatatgtattgtatatgagcatcttagcctgggttctttctggaaaacagagcctacaacaaggctcgaatgcagatagtttgtgttgattagttatcccaagactcagaagagacactgggaaggagaatcaatatgggttctagaattgttcaccactatagggaactgaagttcgatcccatcgggaccttctgagaagccctgcagaatttgccttggaattgtccaacctgcctgacaaaaactgaagagggagaatgtatctgctggctctaatccaattatcccattggtcaaagcttgctccttggggtgttaactctctcacactaccaggtttttggaggtaccagagagctctaggacagaaagcaaaggtagtgcaactgaagtgaagcagattgccacagcagtagctggagaaaaaagtgggctgagtgggtatgagatggggcttaaggggtgtctggtataatgaaacgcctctaagtggcaatccaaattttaaagtattttggatcacataaagtatcctgatagtgactgaaatcaagatttgcataactcacaaaagcaagcttcaaacagtagacataacataacttttgtgtaaaaaagcagtgtatttatagtgaagaaaataatttcaagaactatgcaacagacttaatgttggttgtctttgcaaggaataggataaattttagaggcattaactttaaattatgtgtttgtataatggttaaatatagcataacaaatatgtgttaatcagaaaaaagtagtactaaaatatccatagaaatgcctgaatagcaacccaaaatctagattaaaaatgagtattttattgttagatacaatgaattagatctactacttgatagcacaacagagtgactacagtcagcaataatttgttgtacattttagagtaactgacggagtattactggaatgttcataacacaaagaaatgataaatgcttgaagtgatggatacccccatttaccctgatgtaattattcacattgtatgcctgtatccaaatatctaatgtactccataaatacctaatgtatacctactatgtactcaaattttttctaaaaaataagtatttttaacaaatgagtaagagtttcaaatgggtaaggagtgaaaacagtgccagtagccaaccattgactaacctaaagaacatggctgaaatctttctaatgccaggcagatttagaatcctatgtaatatattaatagttcttaggaaccttttcactttagtacactggactgtgagttaaataggtttttagaacatccccagtgatggctgccatttagaaggaacaaggagaccccagatgactgaatagagattatagtagcttgagataggcgctagaacatcaactgtcttagcctaaaccctacccctaaatctttattttgtccagaggatagggaaggcagttttcaagaggaaggagaacttatcacttatgaaaacttgttatagcctaggaattccacaaggcaatacaggttgattgtcccttatctgaaatgcttgagattagaagtgtctcggatttcggatttttttggatttgggaatatttgcatgatatacttaacagttgtcactaatctgaaaatactaaaccaaaatgctccaatgagtgtttcctttgagcatcatgtcagtgctcaaaaagtttctgattttcggattagagatactcaacctgtacgagtgtcagagtgcccttcaacacatgggcaaactgagagagctgaggttgtgaggtggtgtatctttccctgaaatagatctgtatttaaggatgggtaaagaaaaagaatgggtaagaggagaggaagtatcctctaatatattagaagaaaatccttccacatgaagtaggtttattatgaacacttgtttaatgttttcagttgagccaaaagatattacctgtattaaaaaagaataccatactataaagaaggtaaggtcactataaactgagagcaaagtgaactaagaaaatagtacattaaactaacatggaagcagaaaataaaccatggagaaagcatgtatcttcccaatttttttcaattaatttgcatttctttcataatgaaaaagtataaaagtatgtatttattatagtatagttagaattctgattgcttataatggatgattttatagtacatatattgaactagtcagaagggacttggacaatcctcaggctacattttctgttcacttttctcacctctaaaattggagagagtctttctgcttaaaatcagaaagaagtaggctgtgaggaccaaaatccctggtgggaagggagattggttgcagtgttgggcagggatgtctgttaatatgaagtgtgagaatgaataaaaggagactgaacatcttgggtttcctttgaatttgccattaagtataatggaacagacaatagaatacaaccataaaggacaaaaggcaatacagataatcaatatagtatatatctcagtgattatcgactaaagataaataatattatgtttcacttctattgatctgatcttttccttccagttagtttttgttctggattacacattctctggcaggttagagcccatctgttttgctctgtgcagatccttgttttatataacaaatgagttacagagaatctggaattttcagttctatactctacttactcctcactcctgcctttcagtacacccattgagtctggagtgataagctctcctgagaagtcatttcagagcttgtgctttagcagacttcctctgcttgtccctgccctgccattctcattggtgagcctggaacacttgtcggctttgattaaactcatggaaatcccaggccaggcgtaatcattaaggtcacattgtttaaatcagattgttctgagctcacaaacaccttttacattagccaaaggtatggccttgtatatggcactttgtattttagcattttaccccattgcttttgtaaagataataaatactgcaaatgcctattttattattttagtgttaatattatcttctagttatatagtactttacagtttacagaacattctcaggaatgctttcttctcttttttctctttttttttctccaagctatttttttcttttgttacttaggtttgatcatgaattaggcttattttggcatgttaagtatttgttttatttcataaacattctttgtaattttttcctttctttaaatttatgaattccttgcccttaaactccatctggagtgagattattatgtcttctctggtatccagactagaaatagcttaaactgcatagagccaacagttagatgtaagagaggatcctggaggagaaagtaaagggctcattttagtcttttccctgacatctacatcatatcatttatgaaagtatagctttcctcttctgatggatcaaaaccttgaggatgtgtttaagtactggtgtagcagcataccccaaagtgaaataaaagtgatcatattaatgttaatagcttatctttagagatttcttgaaaacaatggtactctagtgacttaaaaatccctgaagataattttaactcgtcttcaggaggtttctgatgctgtgatgaagcagcttttgccagttgtagcccagactcttctaaaagctatgatcttgatccaaatgcaaactgaattttttttcagtatggttgagattttgttggtaactgtagcatttgaacatataaattatggtcagtctcactaaaacatcaactctaatactgagttttatagatgaaaaacgtaagatgcttctttatgttttcgaagttaaggtcacccttctgtctcagccccctttattatctttgtggtcagcctgaagaaatgtgctaacaatattgctgaaataggcgttggattctttggtgtcatattatattattttcagattttgacactttggtggttaattgcattgtaaattattttaactataaattctccacaactgatgcctcatgcaggaaaggaaaaatgagaaatccagatataacatgatagaggtggaaaatgtttgtctttcctgggacaaaaagaaaatgtgtgtggcctatgtgaagaattaaaataatctggttttagtgtttctgattatgatttaggtagacattttataaggcagtatatttatttatataggtgtttttgctaacattacatttgctgaacacattatgcattgcaagatgcttccatattcatactgactctgaaagtacaattcttgtcctcacagtagtattcatttttgttggggagtcaagtgaggtagaataatacagtagaaagagcagcaatctgagagttaaaaggataggtgtcctgaccccattctggcatttactagctgtaaagaagctaagttagcctttctgactaagttgagggcttggagtatctgtgacttttaaggtctaaatgccataattcttagatgacaaattcacaagatcattagaaagcagtatggccacataaagcgataaattgaagaactgtctttatttgagaccactgtatatatgaccaaggacactatatatttttaaaaataaagttagcaggcacatattcagttttgatacatgggcatattgcatagtggtgaagtctgggcttttagtgtagccatcacctgaatggcgtacattgtaaccattaagtcatttcttaccccttaccccctcctaccgttccactcttctaagtccccagtgtttatcatttcacattctatgtccacatgtatacactttttttaagctctcacttatacgtgagaacatgtggtatttgactttctgtttctgagttatttcacttaagataatggcctccagttccatccatgttgctgcagaagacatgattttatacttcttatggctcagtagtattccatggtgtgtgtatacacacacacacacagagacatatatgtacacacatatatatcacattttaatccagtctgttgatggacacttaacttatttagttccttatctttgctattgtgaattttgatataatatttgttttcctttgggtagatacccagtagtgagatagctggatcaatgctatatatttttttaaagtgcaattatagtcactgtcaatgtaaagatttcttccacaaggtaattgaatcagtctggaaacagaagccacacagtaacttaaaggaagtttgatataaataattataaattatgataagaaatacctgcaaacaggtaaagagcgccctaaaccatgtcctacaactgaggaatagtacccaaggaaggatatcttttaagtggaacacccttcccaaggctgagaaggtgtggctgcagcttcattgggttgcatagatcagagcttatccacagttgccaggcaagtggaagacaaccttcgaggatgtaggcaaatgatgctgctgggaaggttcacagcaagagttaggatgatgctgtgagtaagaggtctggagagcatgctgagatagcctcaggatggtgatcactgagcccaggctgaggctgcaatgtcactgtgggactgcatgatctggacatgtggctggggcacagcactaccgatatccccacacacatgcactgctagtggaccctgcaacaggaacaagaaaaaaataaaagaatgcccatgggaacctagaagccttcttctccttgcagtgtccctccactgccctctattgacaaaaacttaacattgtgcttactgtacaagataaatgcttagagtccaatccattgtcacagagcaagcactgaaggatgaattgagctgagagccacaaaactcataactgacacagtgtggttagctcttacctccataaaactacatatagctacttcacatttcttgactataagtgaagacatcgctcccaggtctctgccgtttggtccctatttatccataaagtgtatatatatagtgccttaaatttccagaagcttatctaattataatgaactgcttcactcttgctatttgaatataaaatccaagctaaaatcaaaacatttttctaataacctacatcttagttgagctatcaatatgtccagtctgttctttttcttgagcctgaaagtcatgtgtcctctaatgagtgatctctcatcttcttcggaacctgccacaagcctgcttgtctctgtttcctgcctatgaaacagcagataaatagaattgagattttcccagatccaattctggtttccagcttactctatttccctatcagaagtgagagtagtggtggagcctcttgtcccaactcttaattcataccagattgtttcaggtaagtagctgaaagtaggctcgaagtgtcatgggtgaacttcttactcatcaaaggtgtacatttgggactgacattttctcactgttttggcattgaccttatcattcttagatgattattatcttaaagtgtaatttttaggctgtattattatctcaatgttgggctcactaggcattaaaatatttgatatttacttgccaaacaatgttcaaagcacagtggttaagcacgcaggaactgaagcaaaactgcatgattgtaacttggctctgccatttaaaagttgagtgaccttgagcaagtttttaacatctttgtgcctccattcctacatctgtacaatagagataatagcagtatttccttcttagggaggttgtgggggttaaatttgttaatacatgtaaatgacttagaagaatacttagaatatagtaagctttcaataaatatcagttattgtttcatttagtcctcctcactatacagtgagatcggtattatttttgtcccaattgtatacataaggaaactgaggcacacaaaaggattaaacaactttccccagatcatggagctagtaagtggtgaagttactattcagtctgaggcttttaatcactatactatagctgactctgtagatgacctcgaaatctaattctaaggtcataaattatagacatttaatttcagtgactttcttttgtctttctattgataattttcctttggcattcatggtagacaggattctaagatgacccccaggacccctgtcccctggtatataactgccctcttcttcagtgtggttgagaccagggaatacaatgaatttcactctcatgattaggttttgatctatggcaaaggtgaaggaatttcaaggatgtatttaaggtctcttgtcagttgactttaatataattaaaagagagattatcttggtgggcctgaccttatcatgtgagccctttaaaacaagattcaaaggaggcagatattctcttgctggccttgaagaaatcagctgccatgttgtgagagggcctgtgtagggagtcacgcagtgaggacctgaggacagcctctgggagttgagaacaatctccagatgacagccaacaggaaagtggggacctcagtcatacagccacaaggaagtggattctgctgacaacctgaatgaacttgaaagcagattcttccctacttacacctccctgtaggaatacagccaagttgacagcttggtttctgccttgtgagaccggggactggttccagtgcctggactcctgagccatggaaactgagagaatgtgtgtttctttaagcctccaaccttgtagtaatttgttacacagctatagatacctaatacagtatcattaatttaaatttcaactcaagaagaacaaaaacaaaaaatgtattttttaaagccaaagagagactagtagccagcagagaataaatacgagaacaattcttttgagaatttaaatataaggtactatattgcctcctaacttatttgattcatgtcttatttattataaatacttttttgattagaggcaacaacatgtcattgtgaaaagaacatttgactaagcatcagcacttctgggttttagtcttgacttttccatgaactttgttgtgtgacacttaacctctcatggatccccgagtgtcattcaggaagattaaacaaaatgatttcaaatcatctgtctcaaaattctgtgaatataaggatttaagtaattagaagcttgtagtaacaggactaacactgtcaataagctttaggacctttaagttttaatgtgggaaaatgtaagaaattaggaggaaattatgcttttaagatcatgaattttgacttactaattttaacgcataataggctgttaggggtcattgcttcttttctgttatcaggaacacaagggcagcatgctcagtgtcagtgatggtaagcacaaaaccaaatacattagcagaaacactgtcccaggctatgaaattcttgagtgtagtagttggcgtttgaatcatgtaacagacacttagtgattgttgaaggcatgaatggcttaatgaaggctggtgatttttgttgtgtttttccccaccatgagagtttgacatgtaaagggattgtaggagttttccaggccttattgggatgaagttcacatgacctttatttacttgcaactatttgctttctcaagctatttgaaaatcttagtctttgctgtatataaatataattttaatattgggttaaaattggaattttattctattacattagtttttcaagtttaaaaagtttttctccttcaattctctgtactcgtatgaacaagaaattcttcctgtgttgcacgtatgtttattacggcattactcacaatagcaaagacttggaaccaacccaaatgtccaacagtgatagactggattaagaaaatgtggcatatgtacactatggaatactatgcagccataaaaaatgatgagttcacgtcctttgtagggacatggatgaagctggaaaccatcattctcagcaaactatcacaaggacaaaaaaccaaacactgcatgttctcactcatagatgggaattgaacaatcactcataggtgggaattgaacaatgagaacacttggacacaagaaggggaacatcacacactggggcctgttgtggggttgggggagcggggagggatagcattaggagatatacctaatgtaaatgacaagttaatgggtacagcacacgaacatggcacatgtatacatatgtaacaaacctgcacgttgtgtaaatgtaccctagaacttaaagtataataaaatatatatatatatatatatataaaagaaattcttcctgagttggagaatgtgtatatggaataataattttaaatactaatttaaattctgtttctgaatgttactctttcaaagttacctatgattgttcaacagttgtgtcttgttagggaaccatcataagagtgcaaaatttctagctcaacagaaatctgtcaagtactaagatactaaacatactatatttagtgaggcgtatacttacagttctcacaacttaatatcagaataaatgtatgatattttataaaaaacaaagcctcccttgttcccccagtacaatgcacatgtcatcctacattggcacagagttgcagaacttataatactgaattatactaatattcaaataaaacaataaaataaaaacatactggctgggtgcagtggcccatgcctgtaatcccagcactttgggaggccgaggcaggcaaatcacgaggtcaggagttcaagaccagcctggccaacatggtgaaaccccatctctactaaaaatacaaaaaattagctgggcgtagtggtgcgcacctgtagtcccagctacttgggaggctaaggcagaagaatcacttgcaccgaggagtcagaggctgcagtgagctgagattgcatcattgccctccagccctggcgacagagtgagacttcgtttcaaaacaaaacaaaacaaaacaaaacaaaacaaaacaaaaacccatactttattctttagacattttaattgaaatattatttatatcaataaatatttaaacatgtacacaactgtttatcaaaataaactttcattactattttccatgctattgataataagcctgaattgtttaaactgtatttaaattgtaactttcacatcattgttgccatcttaagatgtatatctatctgttgcttccttaatttatcttgattttatattttatactcttattccttgtatatacgtatatacccaaaaagtataaatttctttttgtaaagctttttttaaccttatcagccttgagttctttcctgcatcaaatgaattttctgactttttaaactaaagatatttttattcatttgttccagtatacttggaagaataattgaacagtaccccacttacttagaaaagcaaataaaaatactttaagtagctcaataatgcctaagtgtgcttccagactgacataagagttttttctgtcccttagctttttaccactgtttgcacttagaacactttctgcatttcttttttaaaaaaacaatagctggccaggcgtggtggctcacgcctgtaatcttagcactttgggaggccaaggcaggcgaatcatgaggtcaggagttcgagaccagccaggccaacatggtgaaaccccatctctactaaaaatacaaaaaattagcggggtgtagtggcaggtgcctgtaatcccagctactcgggaggctgaggcaggagaatagcttgaacccgggaggtggaggtggcagtgagccaagatcatgccactgcactccagcctgggcaacaaagtgagactctatctcaaaaaataataataataacaatagtagctaaaacttcatgtattaatcttaaaagtatctgataaattcagatataatgaaagaaatctattcagacataatgaaagaatgctatcttattattggttaatgtcttaatgtgggattattattttttgaatccccacattaaaatgttgctttattttgtgctaaatatgctctgctctgatctttttcccctttaaagcttatatttaggtaaaccagcgtgtatgtgtgtgtgtatatatatatgtatgtgtgtgtgcgtgtatgtgcagatagatagtatagaacagaatacaaaaactttgcatttcagcctgagaatatgatgtattatattcatatttgaaattaatataaactacctgagaaaaaaaacacacaataccataaaattcagcatatgacactcttcagttttaaaagattaagtcatggctacccttgtctgttattcagtcattaatcctttgtcaccttgggtagtttataacagaatccagaaagtcagttaaacatttatttccatttcatgttctctgtagcttttttaaggcatatcatttactattctttaattttaggtacaaatttttcttctatttttagaaataaagataaatataatttaaaatacctcgggggctgggtgcagtggctcacgcctgcaatcccagaactttgggaggccgaagtaggtggattacctaaggtcaggagttaaagaccagcctgaccaatatgatgaaaccccatctctactaaaaatacaaaaagtagccgggcgtggtggcgtgagcctgtagtcccagctgctcaggaggctgagacagaattgcttgaacccgggaggcggaggttgcagtgagccgccactgcactccagcctgggcaacagatcgagactccatctcaaaaataaaattaaaataaaataaaataatttgatatgaatattgcgaaaatagcaaataataacagtggttactagtcatcttctagctagtatagagttgtccttttgctggtaaaattgctctaagttttcccagacagccatgtctttcacagtctcagttctaatattccttatctaaactacattctaaattgcaagaacacttgcaagcctgccttatattttgttatactatgtagtttaaacatgttatataacatccatctaatgtagacattgattttaaacaatacaaaatgaaattgatcaaaaaaagtccagtgctaagcatagaaacagaattagcacaataatgattaggaattcaagtccttctgccatgctaatgaccttggtctatttagcctccttctcacatctgttaaactcgctataatacctactttaggaagttgttattaggataaacgagataataaatatgaagtatttagcattgtgccagacacatggtaggtgatctacaaattatagctaataataatgttgttgaattataataaaagggtatttttcttgctattttatgattttctttttctagaatatgcttaggtagtaatagataatattgtgttttaaaatataaattataataatataatgtctcacatgatttcacttaatgaatagcattgaccaaattcaggttttgtaagatacattaaataacttccctggaactttcctatagtgctgctaatgtggtttcctgcagtaacttgatgtatgatgcagtaatgagtatagaattagcatgtaaagcaagaccattttataccccttctaattgccttatttagttaagtgccaaatgctacaatataaagtttctagcgtattatctctaaaacaggaagcaaagttctaatggggtttcttttctaattctattttttaagacctttaatctgttaactcctgatagctttgctggtaaagtcaatgtgtttactcaccttttgtattcctagcagcacctagcacatagcaagcatttggcaaacaaaattactcaagaggaatctgagaagacgtttttgcaacttaatatgatgaatttaattggtattttcttttccctaaaatgtctacagtctggtatttctgcctttcctttttccactccagttctataaaactaccagtgcctgaataggagagctactgttgctcattacaagagtgttatatgaggccttgaatgttgtaagaaatatacatatgtatatatagacagagagccatttatatacatccattactttcctatttatgtattggactcttttgaaatatgcttcaatttgtagaaaccacaagggttctttttaacatactgacttcgtacccttcagattagcatgctatccaagtatcctgtatagaaacccttcagcattcacagtgttatctcccctacttgagataaagagaaaataagaatgaaaatataaccacataggtaagggaaggaatagctaaaagatttaattctgccattatttttcttcctgtcaaacatagaatttgaaccgcagccagtttttatatgttaagtactgccattctgtcctttctccatggctgctgatgtatatttttaagacaaatttttaaaaatacagagaatgggattccaggatgggccacataatttgtgagacctagtacaaaatgaaaatgccaagccccttgttcaaaaacaattaagaattctaggatagcaacagcagagcataaaaccaagtgtaggcccatgtgcaactgcacaagtcaccctcccacaaagctggccctgaagggtttcctatttcaggggaatgatcttcctgttggcactttgcctagcagcttttcagagtaaataccttcattgtatctaagagcattgagacctgagcgtcagagagagtaaagagatgtgaactgtccatcatggccatgcagctagactaaccagtgtagttactgatcattgtaagatggtcagcaaggtaattcaattaagaataatgagataattcataccatgaataggatttcagtattttaagggttgagaaagcaacagaggaggaaaaagcatttattgggtgtcttttttggataggagccatattgaactctttttaatgcattatcatgtcttagcatgtcagccatataaagtaatctttattagctcatttcattttctatctgaggaaagtgaatctcaaggatataaaataacttgtttatagtcacacagcaatcattggcagtgtggtgattgcccacaactgtcttcagatcaagcccatgttctttctatgggtattggtaccatgaggctgtctctcttgaggggctgatagacacaataaaagtacagacttgagaagcagatgcaaacagcactagcacaattagcgaaatttagcatgacagtttctttagtgtaaagaatctgaacccagcacaaagtgaggccatggaccaaggacagaacatagtaaataaaaagagagttcttattatcttgaccagacaggagaaactgttgtgaggggaaaataaatctcgggatccccaaatcactaagccaagggaaaagtcaagctgggaacaatgtcagtcaaacctgcctcccattttatttctaaatacggtagctacaaagataagaagctacatacctccctcacaatttgcccacaaggaaataccttgtggacaaaggacagacagaactcaaagtcattcctctgaggctcacctgagacaaatgcatatctgattgcttcctctgccctctttgtttatataaaaatgcagattcactgagccagactaaattttgtattcagtggaaggctgatcaaagactcaaaagaatgcaaccttttgtctgttatctacttctaacctggaagcccccacttcgagttgtcctgccttacaggactgaagcagtgtacatcttacacatattgattgatgtctcatgtctctctaaaatgtataaaagcaagctgtactccaatcaccatgggtacatgtcatcaggacctactgaggctgtgtcacgggcgtgtccttaaccttggcaaaataaacttcctaaattgactgagatttgtctcagatattttgggttaacactgtctacctcacagtagactaataacagtggctacagaacaaatgtaacatgttggagatggatagatgataataccttgattgcaaaataatagttcctcctatagttaaagcaaaaaaaaaagtttcaaatgatgaaaatcaggcttcagtaaatacaatgagagtctgtgaagcatctgagggccagcatattttagggcagtatatttcaagcttcttcactcctattctactttcttcatgattttgccatgtgtaagccttaaaataccatgatagctgtaacacatattttacatttattgtttcatacagttagtacgaatggatttatcctgacaaaagcactagctttctgtccttagtaaagccactctactaattgtttaagctcatttgctcttcagttcattcaactaatatttattgaatgctttgtattttctaggatttgtctacctgatgtaggtggtaggtgggggtggagggaaaaagataagaagacagagatgagtagggcatggtacctgcctcagagggattcagaataaaatagtttcgcagtttcagattgttcatagaatgctgagaaagcaggattgagactttgcctggaggaggtgggaaactttatacaaagttgagcaggaaagtctagataaataagtaggaagagtttgttaagcttatttggaagattcatctttcctggatcttggccagattttttttaacttttctgaccatgaattaaaagacttcgagattttttatagtgttcagttcaatcttgtggttgtaatcaggaggttctcagattaagtttgtttaaccatcattttttgtaggtatggtaaatcaaataatagaaacagtataaccataactaatgaatattttggcatatagttcttacactcataatttagaatataggtgtgttgtgtgtaaatgtgtttccatttcacctgaatttctttgtacagattttacagaataaaatgccagttactttcttctactgtttatttttccttatgaaaacgttattacaaaaggtgatttatatgttacttacaacacgtatttaccacaactatttttgtttttgtgcttccagtgtaaaactctttctggagtctgtgaccacatcatatccctgtcgtcagatcctctggtttcacagtctgctcacctggaagtgattcaactggcaaacattaaaccaagcgaagggctggtaagagataccatgtttatcaaaaccaccatccatcagtagagagctaatgatgtggacaaagcagcctctgaatgtgggaatctatgaatttcaacagacactgaacattttggtatttttttcctggaggagttatggtagtggaagtttgtgatgcatgataagaagttttatgaagataaatgaaaatgaaggagaattgaaaatggtgacttctgaattaatttaatttggtactcatttagcttcaattacattctttcacctccctccctaccaaagttccttaggtttaaaggaagtttaagagttttataataaacaccacaatgttacctgctcatgaaagttggttttttgtttgtttgttttgtttgttttactttggtttgttctggttttaatagttattccttcccctagggtgggttagctaaacaaaactgatattctttataactcgcattcattcttagaagggtaagtaagcacgtggatattgccaacactagatgtctatgagttgtatttttttattatgtaataataaatataatcatgtttgatattttgttcacctgattaaaaagtgtattggttctagatttaacccaagagagagattttttaaaatataagtctataggaagaaagcatataaaaattgatattgagacagaaaacaagaaactggctagagaatatcttaactactacacaactattacatgttagtttggtgctatagtgtttccactttctccctgtatatgaatttaccaattaatgatattttggaaaatagaaatcttgacaactagcattaataattgaattcagataatatattctttaagatctctaagcaagtttaactttttctgtggcttttctttttcatacatctatataactgttcagaaggcaaagcctttattgactaccactgatttttcagtttgaggccatctatcctagagagtaagttttctgcagatatgtggcaaattaattctggttatctgtagttcctagtgctgttgtggcttttatgggtgttttcctgggaaggaatatgatgaaaatcagcatatcagacatagcatgccatcattgtgatctgtaagtgctatatctaatgttgattacatttagaacttctgttaagtaattataatctaaaatttttttattccttttagttacatctacaaagtccagttttatttttaaaacacttcaatctatagcaataaggattggcctttctatgtatccccttttagtagttataagggaaaggaagtcccctaagcatgatttttagagtgaaaaattatgaactaatacaacattgtattaaactagaagtcagaacacccagatacaaataacttacataaaatataactatgagagtgatcttgaagagatgggagagtaaatttaaccaccttggccttgatctagtcatgtaggtgagggagatgaggagatcatctttaaagctccttctggctcttagtctgtggttctaaaaagaaaaaagcctgactttttttctctaatttccactgaaatcattgggagaaataaccttgtaaaataagtcaaaacaatgctaattaatgggctttatgaaatcttgattttttaaggaaggtatagccctggacaggtcctttattgttttcatttgaaagaggtagatctgggaacttaaaatgctaagaaccagattcagttaaacagtttaggagagagctagaagagaaaagaaatgaatgcccatcacttgccaggtatttttctcacacctctatagagtagatattaattttctcattttgcaaatgagaaaataaaattgcacatattcaccagtttgctctgtatcacatatagacaataaataacagaggcagggtttaagtccaggtaaatctagatgaagtacatctgaacaaagctttttttactattccacattcaaattttgaattgctaaacaggtatgagaagcttaggaggatgactttaaaactgaaattacttagagaaatttgtttttaaaggacaaggggcagcacttcactgggaattgaaaggaaggaaaagaaaaactcaaaatgttgaatattaatagaaagagttaagtataaaactattttttgtgattcgtatcaaaggggaagtactaaacagagaatttacatggcttattcaaggtatcgttttaaaactcagtcacgtttaagtaagtttagtcagtcacatttgaaataaaccaattttaggattttgatttaggattttggtaattagccatagtaaatgtctaaatgataaatgaaggaaagaaatagaaagcggtgggagaataccaagatttaatgaaatttaattagcttagaaatatccacagaaggtgttcttccaatgttaggacagaacatgtctcataggcaaaaggtaactgatttgttctcctgctgataaactggatacatcgtttatcagctttctaattagtcaaatctcctagaatttcttaggtttaacagtcctaaagcattgtaaggactggtgagaaacaaccttagttatgattgaaccatatgaaactttcttctaaagtgcttttaaacaacaataattagcagaaaattaaaggaaggaaaatgagagctattgaaacaaccaaactggatcagagccaaggcatgagccaaatagagaggaagggactggggtcatccctggggaaacctcttggcctcagggagttctttttctatttgggtacttggaccatctccaaatatgccttattccaccaacttgactgagaggttgctttggctcctgttggttaaccaacatttggagacagagcaaagcaaatgtcattttggcaacctgagcaggagagagggagctgtgcaagtcagctctagaattaattaatgaatttttaagaagagagaaaaggaggaatgaaggttttgatgaaatggaaagccatatttgtcacggttccagaaaaagagtcatttgaattacatgtcctcctgctgtttggccctttctcagaggtgaacaatgaatcagatgtatttctctggaccctttcttattcagaagatgattagtttgaaactcatccaagcaacttatttcttctctttcttttggtgcctgacttttggccatttttctcattactactatgagagggagattaaaaaagacaaagaagtcagttttgattattaaaagcagttacaacatggtttattgagtttagaagtgaaaatattacataaaacaaaatatctttattcttgtggcatttaaaaatttgttttatttctaccctattgctttatgtctatatgtagatacatctctaagcatttaaaatttttattcatctgaaaaaaaatagctttaatataaattgtacaatgttgtcatgatgagatcctcttcctataactactagatactgtctttggcttacaattgtcagttaagttcctggtatttgtaataattatacacagataaatttagagtcatagctatgctgtttccatgattttttattatcccaataactacagtgtcttttctaaacatttttctttaaatattaggctttctttatgacctcatcatttatagaatcatttaggactcttgtcaaacacctttaattcgtagtcaatagtgaaagatacatggagaaaaatagaatcaacttctgcttacagttgtcaagatgttgacagctgttgtgaaacctcggttcttcttagtttaaaagaacttaaacaagagatacacagcaaaggagatgtagcatagagcaatttattgcaaaggaaaaagaatattgtgaaagttaggtgcagaatagccagtacaccctgagagaggattcagggcaggctgctcctgaggatgagaccgccaagactggcactagggagactccctttatgggagtcttacgtgattatttatatgggggtgggaagagctgttactagtaagcatgttctgggtggtcctctgggtgtgcacgtgcacagtagctgtacatgcctgttcatatgttgcatgtctctttagcatcttaaatctccacccagggctgtgctttttactattataatgagcaaaggcttagtttgaggacaggtaaaatcaaaatgcacgtgctccctccgggggaaatttcctagctgtgcttgaatgagcttgactacattgtgaatgctggggcttattgtgttaaccatacattcgccacagttgccaaattccaaggacatgttaattccttgactacctatcctgcctcaaagagagatgggtaattgaaatgaatttgtaaaatatcaatcccagttattcttttagctacatttcatatactacatatttgctaaagtggtcttagtcttttagaacagatattaaaaagtgaatgtttgactttaatatctacagtcatcaaatattctaataagaaaagttaaggtgtacaactctcctaactgtaaataaagccataaatcaggagcccagtggttgagagtgtggactctggagtcagactgcctgggcttgaaagctggcttcaccaccttgggcagactccccagcctctctgtgcctcagtttccttatctctaaaacagagataatgatagtttccactacatagactattgtgaaataagtgcaagacacttaaaacagtccctggcacattgtaacaagtagatattaatggtggtgatagataatgatggatgataattattttgtgtgtccgaacagtgtattttgttttgttcactttttccactttatcctctcacaacccttatatgtcaaaaactaaaaattggccaggcaccgtggcttatgtctataatcccagcagcgtgagaggccaaggcaggcagatcacctgaggtcaggagttctagaccagcctggccaacatggtaaaacccgtctttactaaaaatacaaaaattagctgggcgtggtggtgagcgcctgtaatcccagctactcgggaggctgaggcaggagaatcacttgaacccgggaggcagaggttgcagtgagccgagattctgccactgcactccagcctgggggacgaaagtgaagctccgtctcaaaaaaaaaaaaaaaaaaaaaaaaaaaaaaaaaaaaaaacacgaaaaatttactctctagctcttacaaatgtgcagtcatgcttcatttaatgacgggattccattccgagaaatgcatccttaggtaatttcatcattatgtgaacaccatagaatgtacttacacaaacctagatagtacagcctactacaaacctaggctagatgatagagcctattgctcctagtctacaaacctgtatagcatgttactgtactgaatactgtaggcaattgtgacacagtgttaagtatctgtgtatctaaacatatctaaacatggaaaaggtacaataaaaatatcattacataattatatgggaccaccatcgtatatatagttcactattaaccaggacgtcattatgcatcacatgactgtattttaagatcctttattaatctgatataatattgttaattcctgaatgaaaaatatttacagagatcttgtcctcttctaagttctaaaataataccattatatttaccgatcagtaaataatggggtaaatgttagcttcaaattaagtatgttgtatacctgtcaccagtgtaaggctgaatattaccatgttgtcataggcaaaaactactggccaatccattaattaaattctgattgtacttttgttaaggttatttgttttatataaagtgataagcattcattttgtttcatattagcaatccaggctcagccattttagacatatggtattactgaaatgactttttagaattaaaatctacccagtgatttctcaatagttccataccatgaaatttactacttatttttctaatctcttattttcagtgaagacacatgtattttcaggtatctaaatatataattaacaaaggtataggaaattaacattgtagcaattgcttcatgtaagtactaaatgtatgctttttctgaaatggtattgttggttgttattattaaatctatatttcagatttgaagttaattaatattaatatttttatttatgaagtaagtattttgaaatgcaaaccacttttataggtaaaatttgggtagtttttccccgaaaataaatttaaagtaacaatcttctttggaggggacaaaaattcattaactgaatcatctagtttgttctgatttacttaaattatttaatattaaaaatgtgaatcccttattgtgattttttttctttaaagttccatcactatccataatttaaagtttccacttgctcttaaagtttgtatgatttcaggatttctgtataatttttaaactttaatgtagttttttctaaaaatggttctatttaaatggaaagtggaatcttgtcctttttactgggggaagggattgctacagatacacactaccttttaattatcgatgtagatatgattggatataattagtaaaactttatcaataagaaaggtggaaaatacaggatactacaaaatagaaggagaaaatttatgtaaattatattttatcactcttctggttccagttataattgaagtgtctcattagaaaactactttccattgtataatatatcaagtataataagttaataacataccaatattttaatttcccattgtaacttttattttgccacagaatatgcagtatgggtttttggggagagtgagagagtttctttcttaggaatattgaattaccatgctgcattttatcagtctcacaggcaattcacttatcaagtagttatttaattgagtataggcttcttcagacaaactttagaaaccagaatgttcagatagtaatttctcaccagtttaaagatagcgtctgtcttcatggatttatttctggggcgtgtggcagttttaatttgatagagtaattttttatataaacgaggttacaatgtacttgaaaattcaccaattgcttcactttcttttctgatgctgtctttttcttagggtatgtatattaaatctacatatgatggcctccatgtaattactggaaccacagaaaatgtaagtattctaacctttcaaatttttaagtgtgtttttcccttttattgctaacaacttatatatctcacatgattgaggttaacatctaaggataaggacatgaacagatagtagatacaatttaaaagagatactgagttagtagcattcattctgttcaaatttccctttttttttgtttagaatagctgtttacttaaagtaaatcaggtgttttcagccagagatttgtctttgtattttctgattcatgacaagttattgtgacatctgaaagaattcatttccatctgtcaaatgatttggttatttaaagaaactaaactcatgcgagaaataaatatcagataagtcaggttttctgaatacttccagtataattcagcttaattcagtggaagggcagcatggtatagctgagtggttttcacagtgacattcctggacaccagcattagcctccctttggaacttgctatatatgcaaactgttaggccctaccccagacctactaaatcagaaattctggagaccagcctatttcttaataagagattctattttaacaagtgaatctgaggcatatttgcgaaccaccataagcagtgggccagaagtccacaggcctatgtctttacaaccagttctgcatcttaatggcagtgtaattttgggcaagacatttaacctctcattgcttcagtttcttcgactataattggaaacaaattatctgcactacatacctcactaggttgtaatgaaaattaaataagctaagaaaaggccatgctatagagaactatctgtgttatagagagaaaagcatgaagtgatcatgctggatattattaacatgatcagtgtgatagaggtgaacagcataatacatcatcattcttgcatttggttatttcagatttccattctattattatataagcaggtactgagctttgaatgtattttttttttattttagagattctgccaattgcatgcatatgcagtgctcttttaaagaagactgaggtggaattagttcaatctcaaattattattgatctgaacattttaccagcattttctttttaaaaatcaacattcttttcatctaattcccctatgtaatcacttactgatatttttccttgcttctcttggtttcttgtgaaaggtgaaacatatatatttgcagttggagtgcaggagcagcttcacatttggtattaaatatgagagtcgtagggatcaagaatatcagtaacatgcatattatgaagattttaacaattttaaatgcagttaagatgctacaaactatatgcttgtcatcaattgttcattctgatttatttattcattcatgtattcatttgttcatttaacagacctctgcttcatgtctgctatgtttcaggcatggtgctaggtattggaagaattttaaaataactagtttggtgccatcaaggcgtggagagcatgtgggggttcatctttataaacagtagtgtaatttgcatggatggacaaagggaagaatagtaaatactgccaagtgaaatcagagaaagaatcacagaaatggttattttgaactgtatcttgaagaattggtaggaatggatctctatattgtctcaggtctgcaaaaaaatgtggagcactgtcttgctcatattactcactaatgtttcataaatagataagtgatcaaaagagagattgagtctgggagtagttcagatatgaaccatatattaatagttcatcttttgattcttttttttcttaaaaatatttaagtatttttggtaacctcagtcatttataattaggagatctgtcttgagtcttagtaaagctgctcactagagtgggtaagttattttgctttgctgtgccctaatttcttagttttcttatatgtgaaatgaggcatttggacaaaattctatctctaggatctcttttaaaactaaaaatctataatttatatgacttctttacttacctgtgcaaaatgtttcagtttctttgaattttatatactatcattttcttctacataatgactagagccatttgctcgatattttttccatactttcctttaaaaggatcagttgtgaaccaaataccacaggaaccaactatagttacaaatatattaatgatttacaatcttttcagaattgtttcatggtacttgtctgacttggtaatatgtccccctcctaaaggtgctgtgagattaaaatattatattattgttatgactctattcttagagttttttattgtagattgatctatccccttaataatgtaattgtgttattacttcagtaactagaactccctggtatgttgtcttatcttgaattatagcctatgacaaataattttattgtgaattttaaaaatgtgttgaatggaggttaacattgtttcaagacttctatgttttaaaaataattggaaatgaataaaaaacaaactggaaatcacttttaaagtatgtcctactccagggtctcaaaagtagcattgtactttgcagattacattaccatattcttcttctttagctttcagtagataataacgaagagtatcacagcatttatgtttgtgtgtgatagataaacacatacacatctatctagacaaatacatttttataaaaatggattttctatatattcaaaagcatattaaaatgcatataatcaataagtagctaacaagaaaaatataatattttaaattcattactcagacctgcaatataaaatttctatcttaaatctcattttaatttcctaaaaactccttaaaacttgtcagtattagcttaccaagtttgtttgtttttgtttttcatcccttttgggaataaaggaaaaaagtgttagattattgcattctatagaaatattggcattttagttcattgaatgtggttttactgtccagtgtattacactatatgtaacatgagaaatagcatcctcttataactagacacttagcatgttatgtaatatgatttgaactaattgctgtccatcttttaatttgctttgctagattattcagaattggtgttactgatgaaataaattagcaatttaattatcaaacttcaaatctttgatgctgatcatattcatgtacttgaaatggatttgttgaagttaatgtgaattatttatatcaaatggaaaggatcacaatacaaaaagatataattttttgaaatgcatttttgaagcacttacccactagagcctaggagagttgcttgtataaagtttacaaaggttaataccaattatcattttttcataatgctctcagaaacgtgttcttttataataaatatctatatattattttgcatttctgtttgttgtcattagctatgcatagaatgcaaactattttttattaatttttttctttctatgtttatttaactggctcagcaggtaaaaacagtgtattaaatactaataaccgtgtttattgctttaattccttgaaatttttaattaatttttaaatctaatttatggagatgaactttttgtagtgtttccagagacaggaaatgactgataaaatttatgttctttatcgtttcttttatattaaattcagtcacctgcagatcggtgcaagaaaatccatgctggcgatgaagtgattcaagttaatcatcagactgtggtatgtataattaacttaagagtcagtgggaggaactaattttgatttgctaaagctttaaaagaatgccaatgaaatgaaattcctgtttgtatacaaaatattgaacagccttttgaaaaaataactgaatatttattcttcttaattatttgatggaacgtaaagcatttttttaaaagaacctgaagagcattggtggtggttgaggttagatatacatttctgtatggaaaagtactagataatagtatatattccatgaactggaataacaattttggaatagaaattaaagtgacagtatgtataaattcaaccttttcttgatacaactttttgaaagtttcattttataaattattgaattacctagtagatgttttataacagcatacatccatttatctaacattgatttgttcattaaagtatctggtggttttggggggagtattttaaatgtagatctttgaaaattttaaaatttttaatagctgaattagctttttatttcctaaaagaggacaacagttttcattttaaaaaatgttcttgccctatgaacctcacaaatccctttgttatctacccttaaaaatctacagtaggcacagaatcccactgccattttttataatagtgggattctgtgcctattgtagatttttaagggttatttttcttaaacttaggtttagaaaatgaacattatatgcttttcattttggactattttatatgtctcagttgattcacttttttccactctctctgccaaaataaagtatatttgttatcttaaaaagttaaaataatccaaaattattaatatcataactcatttgaaaaaaggcagagtttttattagtattctgctcctcgcttactaactcatcagagtgagtaattatttcctattacacaatttaactaaatttgcttttgcatgtcctagtgatggaagaaattttgtgaaaaacctgatttttctcagtgattctaatcataaggcaaatgacatttcaattttggttttgaataatttgagaagtctgtgatattttggaaaggctcctagacactgataattaaagccatgatgtctcttcaataagttcattatctaagtgaagtaaaagttggtaaacgttttcaaaattaaatgcgtgggtgtacctttgacactgaataatagagtgttggtagtagacaaagcctttccacactatgacagttttgatggctttcttttctgattactagaaactgtacaaagtagttgttctgactgaagtttcctgtcccataggatgaggatttgggcagtgggataaagcagctgcttcagtagacgagtagcttttccctcttctaatgtttatgctgcttccatttctgcaatgtgaccttaacaaacatgacatctgttgaatagtttcagcatgcatttccagatggtcattaagaggatagagattagtctctaataaaaataaaattatttaaaggatattgtttgtggaacaaagatactggtgtttatgaaatgaatatgaaagcctttgaaagtctacaaataaactaataaaatctatgtggattggtgacatttaaatacacctagaatgtgtaaatgcatctttacatcacaggaatattctaaaatattgaaaactacacagaatgatctttgggaaaacttggttccagctcttgctctgaaattgacttatggctttaagtgagtcatggtaactgtgcatctgtttacctttttctaatgataataaccatagctaacacttattgtgttcttacagtgtgccaagcatcatgttaagtattttacatattttatttcatttagtccatgcaataatcctgcaaataaggtatatgtagaaattgagactcagaataattattcagctcacccaaaactcaaagttctttgactctaagacccatgttcttacttcaattttattatactccctcccaaaactcaaaaattatataactatccaacaaaagaggaagaatcctaacaagcatgtaagtaaatctcaggattcaatgaaagattaagtggggccaaggtaggagaagaagaaaggaagtgagaatttacatagctgggatagcgagccagctgaactgaaattagaaatagggttgaaacttaactttactgccacttcctcactctgcttctttcactcagataagtaagatatgtaaaaacacctgtcataatgccgggcacacattaggagctcaataacaactttgcaaccgcctttcttctcttttacctgctacaacagttggaccaattggaatcctccttcttggcatactgctactagagccaacaaattgattttggaatataatagagacaagatagtatgttgaatttcatgaaagtagacttttttaataatatgatcggttgccaggtttttttgtgttcaagtagaggcatatttgggcaaaaccaatgcatttcactaaatgtagcctactctgccctctttttcttgctgttgcctgtattgtggtctgtacagtgcatttaatctcttattagataatatacagaggtggtgaaatggaaattctcttaattgaagcaagtataaattatttatagtctgcaattatcccttctctccctacgttcattaccatagggtttggttatgatataatagttacattaaagtatggcctaataaatttgaaatacataactaatattaattctctaatccattaattgactagaatagtgagattgccagtattgttccataccaatttagactcattaatgaaaagaacaatgttaaatcttataattttggatgatactaacccagttagtatttttctgtaattctaaaatttcctatgactataggtagtaatgtaaaatataaaatctgatatttttctttacttaagataaatacaaaaattattttaaatatttccctaagagtctaagaaagttgaataaatcagatgaattcaaatactatttttttaaattgctagtatggtatatcttcaagatgtctaattagatgcctatgtttctagtttgctccttttttaaaagtattttcttaattgaaatgaaactggaagttttatgtcctttttcatgttgctatattctctgttataagtggcttttaagtttttcaaaccaacatacttctgtggctgagaaactgtggctgccagataggaagaagaaaaaatcatgaacatccaagcaaagcagactgagtcttattacatgtcttccccaccattgaagatccaactcctcaaaggctgctggaatctcccaagattttttccacttcatctgccactacatccctctctctgggagatacctcggcatagtttgatgcagcaactctgccctcatgatgcacttttaacacatttttttagctgatgagactacttatagttattaaaattattggggcatatttataatctgttcaatttcatgttaatactgtttttggtgtgcaaagggttctaaagattctatccatactaaaaacagtctcgggaatatcacttgagaagagtggcatatatgatggttgaatctattaacaacatttggaagtttttccttttattttgtattaatattaaaacatattcactgttattttgaaagatattctggaacctgatgactacattatggaaagaaatgtttcaatagatgaggctataaaggatactggaatggaaaataaccaggttgggatagtcaagaagaagatagactgcagcaaataggatgttctacattgattagtgagagatggaagataagtactataagctagtggtttttgttacctccaaaatgataaacattgttgagcaagactaaggatggcagagagtgtgggaggagggaacagattgaaggactatctcaaaacttcctctaacttcatttatgcgtctcccttactctcactgttgtctctcattttggactctgtcctcactctcttgttccttcaaccccagaacaacaggagaatattgttcaaaggagaagccaacataatcagaatggatagagagtgtggtatccccttaatattcatctctccttttccctccctctcaatttacctccttccctggacttcagcagaaatgaatgagtcattgagtggaatcaataccatgatattgtctaacagcagatgtactttctttctcttttttgatttgctaaattgttgtctttatttttttggtttttttctaattccattttcttttctttatcattctcatctcttctcactggactatttctcctccactcttcatctcattaagttttctttgttcttccctattttcttctgttctgctttctcagaggagaaagtatttatcatataattccatatacctaagatactgaaaactgagaccacaagaggcagtgtttctggtgtaccccacatcttattcctgtaaacacacatgttgctggactacagagattaattatgttagcatggtgtttaacatattgcttaataaataatgggttcttataatagcctaaaataactatgttaggattctgtgaaatcagtattctaaaatagaacaagtgaatcattctcttttgggagggggaaaaattatgaagagacatataccaaaaattaaggaaatgatgcatcaatgattttagttactcataataatattttatttcagattctaccttatgtagtggtttatgagagcttcatagattgtttttcttttatttcacattgaacattatggatttgatgagaatgtgtggaaactggttttgaagtgatacgtattgatataaactgtatttttattttgtacagagaaatcaatttattactttatcatccaatataatatttcatgtttctgttatcaaactaaaatttattatcttaagtccttatataaaggagataaattgtatgatatctcaataatagttacttcctgttaaccaatttattttctctgcagatctctgcatcctgatttgtttctttcttatttgtgcagttcttactagctttaccaggaagagtagttgcttttttaaaatggttactgtttcattttttatgattaaactttatctttcagtgtcaacgtggttactatgatctagttattttacatggaatttttagtttccttataagtttatttcatgtgtttaaaatgtatctattggctgaagttcttacctactctggcttattaacttattaagtgtatggctcatttgcaaatcagcatcatcctcagtcaccccccacccgttttttttttttatctctttcataaaaggaagagtctgccagtcacaattgcccaatccacttccttttcatattaggagtaggcaatcagtagataacatttaactgcctgataaaaaattatcacatgaaagggaaacgctaaagaaccaccatataataggaaattaaatagatgatggcattaatcttaagttctttttagtttatttagccctaggactcaaggataggtttcatccactaaattaatattctgattggcatggtagctcaaattgtaggtaacatagccactcattacttttacatttcctctcacactgtcccttctgcatcttattatcctaatagtggacaataaaggatttttaaaagttggaaaaatggtatatagaattcactatggtctcatatggagctgacattgagttcctttttttgtctgagttgctggaattttggtaaagtgatttctaaaggtaacttccacagtgaaaatacagccattacagaagtttttcttactaaaaattctattaataaagatttaggatgatacttttagctatatatatatacgtgtgtgctttagttttgtgttgtgataaatatatacatatattgcagtatttgctaaattttcaaataagcatatttttgttacatgtctgctagtaaatgacattgtaaaaatcatttatagcaaagttgtacatttttaaacatattactttttgaatactagggtttgagttgctttttaattttgtcatttaagttcctgaattaaatttaagcatgaattttttgtaagtatagattttccacaaaattattataaatgggagctttaacattttagataaggatgcttcattttactccttagctttggtgactgggagtcttttctttttatttcaaaatacatatttttccagcatctttgtaagaagaacagaaatgaaatataggaaggaatggctgaaatttaataacttaataacccatgtaaatatcttcataaaaaaattagttaaaggcctgtattgtggctgagggcggtggctcatgcctgtaattccagcactttggtaggccagggtggagggggattgcttgaggctagaagttcaagaccagcctgggcaacatagcgagaccacgtctctacagaaaatttttaaaaattagccaagtgtcgcagcatgtgtttgtagttcaaactactcaggaggctgaggcaggaagatcacttgagcctagaaattcaaggttgcagagggctatgatcgtgccactgcactccagcctgggcaacagagtgagactctgtctcaaaaaaagaaaaacctgtattattatggttattttaaaatatgttactgctcttttggggactgaggttctacagtatgatcagaggtttacattacagctttacctttcactacaatgtaattgtcttcctccttttctctctttagcaaaagctttcagacccattcagttttatgttttgatgaagtaaaaggacattgtgaatgatgctgaaataaaaacaaaattggcttttagttttctgtagcatatatgaatgaaaaccatgaaacctccgaaataaaccttaagccttgaaagaccacagcattaccaaatgccatattggaaggggagaaggaaaagtgagctgtatgttcaagatgctgaactatacccacagctttggaatcagcttatcacaaaagtcaagacaccaactatacaaagtccgcagttaatataagtgataggttacaggagatagtgcaagtaacagggtatggaaagtcaccacctttggtaaaactatgtgggtgattcataaaacttacatgaaaaattattatcactattttctttctcccatgaacttcgttatgagtcaatcaagaaattctgatttagctctcagaacttcttgaatgtggggcaaaaagattccaggggagaaaaagtgctagcttcttgtagtgtttgagttgcctctctctcttggactctctgtccatctttagctgtgagaaattatgttctctgttagtgctttctttttaaatactacatatttatacacacacattatatatgcacacatattcataactgtgaaattcacattaagatattaagtattaaaaaagatatatgtaaattcagattgttagcagctcaacatggtctaagttttactttgaaattaagccacgttaaaaaaccaaatgccttgatgtactcttatttcactggataagtgccatttaaagttcaggaggatgtgagatgaagaatggctcaatgaataaagacattaaattgtcggctttttttctctaatgaaaataaaatctttcccgtatttcttcttttcaaatgtttgttccttttatcttttcccaagactttcttcgaatcatgtttataaaaatatcaacactaaagttttatttaaaataggtaaaccttgggacatttctgaatactctgaattacctatttaagttactctaagctagggttaaaaatcacttatttgcatagttccttaaccactgcatacacattagcttatattcctttgtacctgaaccatgactaattctttatttctgttcagtgaataaatgactgtgaaagaacaaaattaagatatctccaaatgtagtagactttaatattgtaagactttttttattaatatttcatgggaaaaaattaggtgaagatggatttcgtagattggtactcattatttaatagttttagaatctttgaaaggcactgtatatcaaaattcattatttctgaaatgtttataacagtatgctatttccttcacatagattgttttcccaaagaaagaggtagtcattggtataaaatgtttaatttattagatacttcagtatctttttagtaacacaaagaaacagaacattataataaatatgtcagcaccaaaaaatttggcaaagactgagtgtcattagtggcagtatgatggcttgtgtgttgaattaagtctcttcagtgctcttaaaaagagcaggaggatatttgggtgtagcatgactcatattaccagacattcatataggcatacttctagtctataaaatttcctttgggaaaaggtatcatctacattacatcctgtgagtaagagtgtgtgtatacacaggagtgtgtgtaaatgttgataatgaatctgtttctttgtcttgtgtagggtaataactttgaaaatattttaagaaatgttctatcttcctgcctgtgggtgtaaagatgctctcttgcaactccaaatatagccatgaaaaaaggtaaaaaaaaaggtctgggttgataggcttaaattcttacctttatgtttatttgtaactggctacttgggaccatagagtagaaattatcttttcatatgttagtcaaataactcaccagctgttatttggaaagcagaccagggcaagttctaaaggggtcagagacaacttcttccctctatgtactgaggggaaaagaagcctatcatctcttcagcaccaaccccaaagcctcttgtgcacctaatccaggcaaccaattttccaggacctgcccacttatgttgtccttcacaaaggaacacctgctgtctgcttcagcctgatcaaaacaattacaagccccatccacaagaaagcagaacctctggcttttagcacttgggattccttaatgaccttcttgggaaattttaatcctgtttatgttgtgtgtaaaatacattttaatgtacatgttggggattatatataaattagtaagctatatgacttgctgttgcttgtaggcactgacttctgctaccttggataatgaagaagataatagtagttcagtgtatgtgaaaaacattatagctaataataagacatttgtgtaaaaatgcatatggtggttttataaaggttcattttagcccatgaaattaatgtgaatgaattactctattaaaatattgataaagcactacaaaatatttttctggaaaaaacaccttcataacagtgtttatatgatgcatatgataaagtaaaatttttccaggacaaataggatctatacccactgttcttttccttgttttaatcacatcattatgactttaggtctggagtattcaagatagaaatgttttttcaaaggttcatttataaggagaaagtttatttgaaattttgaggtacagaatgtctattacagctttagtatcaagtattttacttttttggatgagaggtcatttaatcttttatgcgacaaattttaagtatattacatataaaaaatattttaatactatatcttggttttatgtacaaaactaaaccctcctttcgagtttcaaggccctttattgtctctgaaacatttacatcatcatgtcaccatatcagctcactagtcaagttatgcagtatgccgtgagattcacatgaggaaaatatggtgtcacctttaagaagaggctttatgatgggtactgcatgtaagatgaacctttatggataggtaagattttataagtgagagaaaaattacaagcagagggaagagtggttttgcaaagatacagctaaagagaaaagcacagtgtttgaaggaaacgtatattcattactcaaccaactcttttaattatcaactttctaaaagcctcttataatcatctgaactctgtgtgtttctcctgcctcattactccttcccttgttctgtcatctacgtgtactgaactactgaaagttgctcaaacctgtgatactttgcctcagagctttgtttaccccctcaacctccacatcttcttcacctgtccaactcccaaggaatttggcttaaactcattggaaaccttcattagaccctcaaggatgggttaggtgcccctgttgggggctcctgttgcactctgtattcaccctattgaggtacttatcttactgcattgtaactgtttattgctccttaatgaggtacagactgtgctgcattcactgttgtattcatactacatggaagacacacaataaatacttaagagttgtcttaaaaacatatgaaacacctaaactaatctagacatgagcaagtcactgccttcaaggagctcataatctattacagaggttctcaaattgtggctctttaggccagtaatatcagcctcacttggaaacttgtattaggaaataaagggtcgggggaggaattctcaggccccactccagaactactggatcaaaaactctgggggttaaaactcagcattcttttaacaaggcttcaaggtgattctaacacatgctaaagtttgagaaccacattgaagaaaagtaatctgagaaaaagctgtgatcaactataccgacaaaggacctgtttgaggattggttatttgttccttagttgggcctttggagagctattaaaggttttgaagcatagaaaacttctacactgtagcagtattttggagctgcaaaagactagaagcagaaagacaggttaggattctggtttaagtctagcagtaggtatccaagccagaactaaggcagtgagaagaggcattagttgctaggatctatttgttaggacacaaaatagattaaaaagaggagaaaagtcataggtgactccaaactcccgactttagaggatgatagggaggtttttttgttttgttttgttttgttttctggtgaatgaaagtaaagagataatgagtttgatttttaaagtcttgtattcatgtaagctaccagtggatattcaagggaagatactgtgctttagaattgaaaagacattaatgtaagttctggcttcaccacttactatttttgtaatcttggccgagaaaacaatctctttttgcttcagtttctacacacgtaaattgggtttaatagtttacctcattaggcttttgtaagaatgaaaatataaataaaaagaatgtaacatagatatgaagaatctagcacagtgaattgttgatgcttgcgattattcggtagctattaacgtggacaagctaaacagttggaaatatgactagagttattgataggaagcaggaatggtagaaagatttgggaatcatgcaggaagctgttggtgaaagctcttaaaagagattattgtaagaagacagcatgaaatattagaaagatgtgtaacacttagcctagaggaaacaggtacacttattggtagggaagaggaagaaaagatggaggacaggtaggcagagatgtaacggaaccatgttattttactcaaactaatctttgtcatctattttcatgtttctacccactctatgttttagagttggaatgtattgtgactgaaagttacctaattatttgacctatgcaagaatattgaaacatctcttggtattgatctatttcacaagtcagccaatttcttttttggatatctttttctattagaatatttttcatctctggacgtggtggttcatgcctgtaatcccagaactttgggaggccaagatggggaaattgcttgaacccaggagttagagcccagccctggcaacatagtgagacttataaaatcttgacttattgagtacacctgaataataaatttatattctctcttgtcaatcatcaaggtataatgcatagagcagattttgtttctccatcaccaccttttagtgttttaaatagtagtgttgcctttctggttctgcagttttggtggaaattttccatccataacaaacagtcctgattaggtaattcataaaatttattattttctaattggaatattgctattcatacactaggttcatgtattttgttggtttatttgtttgtttagaagagtaactcatgcttattgccaaaagtttaggaaataaaagtataaagaagaaagtatgtattgcaagtccttactccctttaatctaaccaccattaatggtgttttctatatttatgtacattctttaacaaaagtggaataaaattatgtttgctattttggaacttacttttttcacacaatttttatatcccttactaatggatacatttacataatgtacaggttttggttgatttaaacaatactgtgacacatatgttgcacatttatttttgtgcttttatccaatcatttccttatggtagtggaagtagaatttgggagccaaagatatatactatacagttttgatgtatatttctttgctcttgtttaaaacattgttaatgtcatgtgaataataaaaggctgatttaaaaatagtaaaattagatacccaaattttctgccattaaataacatcagctgtaaaattaaaatccacccaaatgaactttcttgtcagaaaccaattctactttctgatagaaaagcaattctgttttttggaattgttacttaaaaagagcatgtagaaagtgtgaaagaataggatgaatcaaattgcactgaaaatttcacaggaaaataccatctagccttaaaaatcttcaaattttataataagtaaaatgaaaagaaattggtgagtagaaatcaatgtataaatcattgagaatagttatgctggaaaaaagattgtggccatcacattgaccactttagttagcaattatttgagtgaataattaagttacaaaatgtggttatcattaataagttgttcctaaactctttgtataagtagtatgttttctccctccaaacttgtaattcaaagtgtgcattcatatttttttggcaagcaaaatgaacccttggatttgaactccctttgctttaactcttggctgtagggatactacacagctatcagaggaatcggaatcaatgtaatatacctttgggcacataatagtccccacttacatataaggggaggcatttgaccagttccattactgtagttgatccacattaatgtgatttaaaaaaaaaaactggcagtctcattcaggttatccaagtataatgatcattttgattcatatctgagactccctgagattttaagtattataacatctcacttcttgtttgttctaacttcaccaacactcaattcagctatagttgaggttgcaatttagatgaatgcttattaaatataccaaagtccccattctataatagctgaattccagattacctcttcttcatagcctaggggtctgtgctgcttttggtggaagtgctcattctctccagcttgacaaatatcttccaggcaaaaacatggttattattagacaaagggcaccaattatctttaacttggatgcctagaaagaaactgttatcactgttgagaccatttgctaaatcctgcttacaatccaggataaattttgacctagtgtatttatgtaacacatcctggaaaagtataatccattagggtttgggataaaaggttcttctctcttctaaatgtgaattttttttaaaaaaaacttggaataatagacattttaatgtgtttctttaaagcatagtttctaggatttcagttacctgatactgcatcactagtccgttttgaaagcaaagtaacaaaaattattctatgttcagaatttttaaaggatgaagagtgaagtaattttaacaggggatgcagttgagcccgatttcaagacatttatcaagtactttgatttaattacacaatatgtttttaggtgatattcaaatagaatggcttcattaaatttagcacgttatattttaagtttatagggttgtttggaacacattccaatagctgcttcattggagtagtattatcttgttatttttgttctatctttatagcatggtaaaaggtttattgtattgctgctattgtccatgcgtaagaatgttgccttggtgtgtcagtaccagctattggtagtaaaatatcagtctaatttagagacactggtaccacttatctctaaaagatggtgatgagaaagcatgtggtgtagtttgtaagctcaggacattgccaaatccttgttttcaggcatatagattttttaactgtacttgtgaacagagcttggatctagacctagcagctgagcagcattaatggtgacataatttcattacattctgaattactccattggtaggataccattttagtctttgatttgacatggtaaatgtccattatgttgtctggtaatgatatggactaatgcaataatatggttaatcaattcaaagataaaatttattgagtatgtatctcctgaaaattgataggatggtacaccaattatgtgacttttttttttactaatcttattaaagggggagaacattaaatctttgaatactgtacctcaattttattgtaatgattttgctggttaccaggtggggtggcagttgaaaaatttggtgaatgcactacgagaggacccgagtggtgttatcttaactttgaaaaagcgacctcagagcatgcttacctcagcaccagctttactgaaaaatatgagatggaagccccttgctctgcaggtaatgaagcttaatcataagtcatacaccatcattttagccatagattatctcagtaatgcttctttattgtgcctcatctcagcagcatatggattaatcttgtatgcttttgaaaagttgtttgtgaaatgatctcttcacagctattctaataggcttaattgtgatgaaatccttgagtatctaaaacccaaatgaaaaacaactctgccttaatttgtaaacatttaaagcataattccaaaatgtcacaatttatttcatgccaaaatatggatagaatgaaaataagatggttcgtttttatgatatgatcttctattttatgttatacccacatactcttttagaagaagctaaatgatagtttatagaattcttttaaatcagttcataaaatagtaatagtaatttataaacagtaggaaaatgaaatgttatattagtaattaaaatgcacctagtccaaactaggcgcagtggctcacacctgtaatcccagcactttaggaggctgaggtgggtggatcacttcaggccaggagttcaagaccaccctgggcaacatagcaaaaccccatctgtacaaaaaattaaaaacttagccgggcatggtggtatgcgcctgtagtcccagctatgtgggaggctgaggcaggaggatcatgtaagcccaggagtatgaggctgtagtgagctctgatcatgctactgcactccagcttgggcaacagagactccatctcttaaaaaaaaatgtaccttgtacattcctcctgattgatcatttttctctttccaccctgtaaggtggcaaaaatagggaaattgttgcactagaatttttgcatttttcttcagcatgaaacatcactcttcagcatgaaacgttactcttaacattgataatatatttattgagttatcttgaaagttataaaaatatgattctgattgatgaaaggcaaggatgtaatgattttttttctatttcagtcaggatataatctttaaacttaagtaatttttgtccttcacgaaacgtacattttaaaaataagagactattaccttttcttagaagttaattaaaaaaaaataggcccattgaactggaacatggcccattattcatattaaaaaggaaagcagtatatgaaatgcattgttgtcactgctatgtaaattgttattaagctctatgttagtaccttttattattcatagattttttttcctaagaatcaaaattctccattatacatgaatggctttatagattataatgatttttcattgtttaaaactttactacttattggccgttggcattatacttaatataaaaacacatatatgtgtcaacattatggcctttaaaattttaatgtgaatctatttttcaagttaatatatgtaaaactgtattaatatgtccaaatccatttgacttgcatatatgtttattttaaaagatacttgatgatcattacagttcagaggtcaatgtttgcctcattatctaagtcatagatgagtagatcagactttcccattacattattttttttcactgcattataatttgctttgctccccctagagtttcctattgccatgtcttccctaaagatccttcttcaaagtgtaagggtgtgggaaccctgaaaaagaggcctgtattttcagccagtaggttttcttctctgtatatgtgagtgaaatttaatacctcttctttagtccctcatatttcacattaagcaccaaaaataccctagtttcttgttgatccatgcactcggtttgagggaatatctctagcacatgcttttataatctattcccctgttatattcttttccacatgcacaaactgaagtggagagttaaggtaatggcagtacccagttaagaatcattttcatataaaatgctaaaataattgaaagaccaacttttttgttacatatacattgggtgtaggtattcaaacctagagaaaaaggactttaattttaaaaattacgtcatgtcattccttaccctgtaagtgccttactcttcaggcactatttctagatccattccaaattctgagaaatgtgcctcatcagatcactaattatttttatttgtcatcgcttattcagctatgctgcatgtatttgtaaatttactttttcaaaatgctgaaatctgaaaaagaggaaatcagcattatataagtgctgtatatattgacatttttctaaatttgtcatttcagctgaatttggttcaactaaaagctattggccaaagtcaaccatccgtagataaataatactattggttgggggaggggagactgcttctaacatttttgaaaattacttcagttgttgcctttttacagagcagaggaaagagtattggtgttaattaaatattttctagtggctaaaacaaggtcttaggagtgaggacaatgggtaagtcctctaacataccgcaccactaccgaatctccctgatgaagaagacctgaaattgaaccattacagaattcttcattgatcttaaagttctggcttatgctaaaatgcaaagacacctgaaagcataatgaaaactagtcaaaatttttatagattatagattttggtacagaagatggacaaaatctcaaggtaccaggatctggagggtgaaggtacactgcctccagagcaggaaaagttaaagaaatagtgagatgaaaagatcttgaaggcagtttttcataacatcatgactttatctgaggtcaccttttcttcatagtacctaaggagctacctcagatgtgaaacgtaactgctaaatgtagtaacaatcctctacatagacaggagtgccatttttattgtattcttccttctggtaggtgcagaaatacactggagccaaaatgcccatcagctcatccaaatacaaatcttcagcattcaaacttgaaaaaatggaaatgaggttatttcttttttcatagggtgtaccagtagtctaccaagaattatttagaatagaggatacaaaaggaaataatctgtggcgtttatttaactcaatatgtctatttaacctttttgaaaatactatcccaggcttaatttacctgatagcatttatagattaaaatataggaaagtttgtagtagtatggaggtaggcactgatacatgtatctttttaataaacaagtttatcctaacataaggaataatgattttttaaacttataaggaatcgtttttatctatacaaataaaacaaccttatctatcctaagatagaagattgtcaaagaataccacgttttaattaaagtagtagttttatttctaaaaatactaaaagcatagtgacttccaatattgattaactacaatgatgaattttgatttggattttcttttgaaattcattgatgaaattatagccaaataaacagaagcatacaattcaacttcatgctcacagagcaatttcattagtacatttcattaaattggcagctcttttgatgaattcctgatttctcaaatattttgtgatagaacgtaaggacttaaccatcccttagtcaaatactacaagcaaatttaataatatctggaagctttaattctgttgtcattttcacccatttgtaaaaacagagatgtctcatctgagatagaatctcttattctaagaaaaaccagggattccttgctttctgagagctgcttttcaaaacatcttttcagtggcactctactaatttcctgcattttggtaggcatggtgattgcttatcatcaatttcttctaattcaatgaaaaaaaaacaaagaattgtggataaacctcaaggtatatttttagatgtttgtggttttaaattaatatgtgtaggccaagagcatagatgggtggtgtccttttcttcttatgagagatgtatggaagaattatctggacactgccaagaatgttccttggaatcatcactgggaatcaatgacttttaaaacatttaaaaacccagctttttttttttttggtgagaatgcatctcagaaatgatcactaaaatcagtgctggaattctcaacataatgacatatattgttcaagacatttttatataaaataacatcaagctgtaacattataattatgttcctaaattgtattctcatttataaatctctcattttgctgccatagttacttgtatgattttgtgattttgtgtttttccatttaaattttattgtttaacattaccttgatgccatttttagagcatatttaaatacatttgagcagaaaatagaaagaaaagagtcatagtagttgattttgtttatcaactggtgtaacaactggagaatgttgattgcatttgatttcatatacatagagatatgaatggttaaagtcattctggaaaaatcaaaatacataagtaacaataaaatttaatattcaagttgcaggtcgttgtgactgaaaaaaaaacattagtgacaaaaaaatttatctgtttctgagagttttgttttaaggagagcaagaactagtattaggcatggcactagagaagaaaatcaatttttaactaaaaatgtaattgggctgactgggagccagaagcaattgtatgttttacatactcaaatgagtaaatacatgcaagtaattgtcaaattttagctcaccagtctttaagcaaatcagtcaaaggatctaagtcacatttgtatttttgagccacatgctttcaagattttaatagtggctacagataatcacctataatgtaaaaattgtccattctttctttagttaacatccccaaaatgatgtttactgtaatttgagaaaatggaagtccagttttaatgttgcagtttaattatgcccataagactggacaatgcaggattaaagacactagtgttagcctcaatacaatgtgcagtatttcatgatttgatggaaaaagccattttatagtgtgactcttaagtctttattagttatatgctttataagtaatacatgttttaggcatatatatctgtatttttaagcctaggtagatatggttttctgatcaaatctgtggtcagaaaaaaacacttgttttctctgtattctgacaggaaaggaaaaattatatgcttataaaaggatactcaaaccttttgtatttataaatttgcattctagaaaaagctgtgaaagaactgagagtgggagaattttgaatatatgtatttcccttgcttcagttcttttcaaataattgactacttatgaaaagcttggccagaaaaaagtattcccaataattttccaaattagatctaaccttctttacatggtcaagaaactaaaaattatatgtgaattcttgctgcttaaaattcaggatacattttctctgaagcatttgcttagattattaagagagtcaatataaaacaatgttcttgtactagtgttgggaattaaaaatgtgtttgaactgagtaaggacttatgtgaatgttctgtgctagaatgatggggtattgtgatccatttgagtctgtgtttatccccaagagtgaataaaataaatggccaggttttatacttgatgtaattatttgtatttcagtgggtatttcccccctggaaggcaaagcaagttctgtgtgatcttggcattagtgaattttagagctaactacataaatgtgtaatgcactgttttaatctttaacgctggagttgtctttatgtcattggtttcattcaagctgtatcaaagctgggtcacgtactagaaagagggacaactaaattaagatatgcttgcccagagatgttaaaatgtaaaatgttttggggaaaacctcaacatcaaatgtagtttcttaagtatagaagttcttttctcatggtctttaagactatagagatttcacagatacaccaataccttctatatgtgctcagttaccttagagatgttaaaattggggcgcacaaagaaaagacctcagcaatcagaggctttaaagtgagacctcaaccatcagaggatttaaagctttagcttacaaaattttattttacaatcacaatcttccaatgatgtttaagctggatgagtaagatattattgctaaagttatcactcataattcagtggaaagtttgtgtcataccctattttgtgacacaattttaaagtatttatacattcaaactgacagtatgaaaaatacaagttttacctagaagatttctaacactagcaaattgacagtagtacgttatcaccaattgacctaaggttataaatgtatgtttgaagagatacatatgatgattttatttaggatttggacattttaagagatgcatgccagtgcccccagaaatctatcatagacttgttttacaagagtcacaacatacatgtaaatgtgtcttccctgttggagcctcattgaatatgtggaaggagagcttcatctcaaaaggaccattgacatgaaaactaaatggtatgacaaggtccttccagaaaacaaacccctttggatgggatcaaaagtggatccatgtcatacttgattacataccacagaagatcaagttatgctgaagcttcatgtttactttaaataacaagatgtaatcctaaagcagtccctttgtattgtatccattttatccataagtgttgatagttcctaattttcttcccattcatgttttgtcaataccggagaaggtcaaaatgataaaagaatgttaccctttaattctaccttttttcttaaattgaaatttctttgtagtgcaacagtaactacttttcttacactgtattataaacaaatgattataagtaaatgttgccaggataggagaagctatctttttgtattatatcctcctcattcgattttttttcaatctaaggaatatgcctattaaaacctcaatgctgaaagaattctgtgtttcaagttgagggaagctaaatttgttactttctgtgcattttcacaaacttaaatggctattggtgataggtgtatttttaatgccacttgttacaactaggaatttctcactgataattttagctaattgcatcatttattctgtacttgatttagtcaaatttttcttgtctttctaatgttctttaatgcctttttcattcatttagtcatttgattttttactctttcaatttttgtccaaagttagaaaatttttagagattataattttaaattatcacaaagacccctttgggttaagtggttatttttattttcccatgaaggttgtactttactaaactttatttttccattgcttaatgtctagtttttttaatatgagtctcaaaaagaacgtttattatttagcttggattagcttgttaaaaagagcacagttagtagagagaaatatgctgaatatatcaaatatttacaatgagctttacttggtacaaggcatactgatgagccagatggtatttccatgataaaccagttgaaatattttctgtgacttaccagtcaataaaataacaagccagatgagttaagcaataggattgactaatttcttttttctctgaagtagtattttttccaaccagttcaattaattgaaccagcttggcataatcaaacttgttatgtatttaagcatatttaagagtctttcccctctatgtatgtgctaatttaactaataacattaactgatgacattgataggaactgtttgctaaaaatagaaacctagagaaatagcagtttgaaggaaattgagggctaataattacatttcttggaagggaaaagacacaagtaccctaggtagacaattctggtaatagtccaggcagaataaaatattcccttggtcattacctcacacttcaggtgtatgtattttaaaatatgcttgtaaccattgactactactatttccttccctcctttttgtttggggagaagaagggtaggtactaaccaggaaaaattatctttagttctgtagatggtaaaagtaaagaagagaagtcctcaaaatagaaatagtgactccaggcgagaggaaagacaataaaaatttaagtttgattatgtttaaatgcttatgtttttagaacttgattttaagttcatttacagtgttaggatattttaaagtcagaaagctattagagcatttaaaaagcatactgaatattagtttttctctcacagtgtatctgtttcaaagaattggagaataatattctgttaagtgaatgttttctttgctacatttctattatggtgaacttttggtcagatttattgtttagcatcgtctgtatttaaaaccaagatgtcctgacagagaggaaaacagttataaacagagtcacatcacagtgactgtgtgtatgtattgttgaatctgccattcaaggatttgttgtagaggcatgaaatgcatccttagaaataaaatagttatttatttccttgggatttatggtattcatcagtacaggtgactcctatgattacctgtataatctcaggatttcccattgcctcaagttttgtttctaaaagacaggaatagttgaactggaccctattccaaaattagcatagtaaaacataatctttactgtgtaattttataatagcttacaattcttcaattaacatgtaaaacttctgacctttttaaaaatatcgtataaggtggaatattgtaaactcccaaattacattatcattccttttccctttctctctctctttctttaatttctacttcactacattagaatttaactgtcattttggtaggatgtatgatttcaagctattaaggtgagctgtataacagggaaggtcaaaaccgtgaactgagtcctaaattatgtagcctaccccagtgacttacattgtactttccattgtatttatgcttggctttttaagcgaattttgtttatctgtacaaaagtattgtcacaatacaaaatagttgtaatatgccactttttgagtgtctagcaatgcatattaaaacaatagaactgtgagtctatataaatatgctaagagagttttcatactggctaaaatggcaacatcttgtcatgtgaagatacagttcatttgtgatcattatttttgtgtttgtgattgcattaaaatttttatttttaatgtgttaattgtatacatagctaatcattaagatctgtaagataaacataaaacttgtgaattttagtttcacttcaggataatttcacaaaccactagattattttcaaatgctgtgaagcttggaattgggagtgctcttaagttaatgcatcctcatgtactgtttaattcagtatatatattatcttaactttaagaaaacaacctcctatttaatacttaaatacaggcctgaaaatgagatctatatatgcaactaaagattattttaaatgatagataaatgtgtgtgcctatgaatggtgaaatgattgtgttacataattaccatacttttgatgatgtaccataaaatggctttgagaagacagctatgcttattttgacagaaaaaatatgtctttctagcaaatactctcgtattggcctttcatactcccacttttgtaaccttttctgagcatctgtaacattttactaacctagaaatatggtttatcttttttgggagaagatctgaaatagctttctcatacatcaatcaggatgtgagtgagctaattcttttgagttactcatcattattgttcttttaaaggtgggattctgacaaagttaatttaatttaaataagtttctaactgtgagataaatcttcccattttgaaacactgcatggtatttttgctttataaatagtatttcagtgtttatgccatagattaaggtgagttgggagtgaagtggaaacctttaccatactgtttgtttttggagattgaaaggaatatccatgtactaaataacatgtttcttgatttcagccaagttcaaaaactgcagaaatagataattttaaaatgataactatgtgtcattgttgttgttgttgttgttgttgttgttgttttgtgtgttgtttgtgtgcgtatgtattttctttttcattttaaccagcctcttatacctagaagtcccacaagcagcgttgccacgccttccagcaccatcagtacacccaccaaaagagacagttctgccctccaggatctctacattccccctcctcctgcagaaccatatattcccaggtataaaactatcacgttgtcctaggcagcttctagctaaaggtaaacctaacagcatataaactgcaaagtcaattctgaaggaacaccttgaatattttctcacagttaggaattctgaacacattctgcaaaatcattcccattatagagcatgcatgtttattaataataataataactaatttgtatataaatacttgctgtgcattaaataatttatactatctcataataggaaagaagaagaaagtaatattaaataataattaggattattttaataagtaaacaataagtgaggctgtttggctaaaaagccccagaaaatttcaggttactttgaagcatttcatacattttttttttaaaaaaagagaaagctatagataacttttatgctttcttaaatgtaagtaatgaggaagattttatttggtaatgatgatgagggagaatgtctttttcccctaataatcctgtgtctgaaatttttatttcattaattcattaatgtttctttcaggaagtagagtttacaagggaatgaattacccttaaagtctattttctagatttcttgaggctgtatctctatttcatttatcgattcttatttgaaaatccttgcagatgtggaagaatacagctttatgtcataatgcattcttcctaaaagcattctgatatccagccttgtgaaatacaaaaattatggaaaaggactagcactaaatggggatcattaataccaatcacaaaaaaacttgattcagtttttaaattagttctgcattcaaaaacaataatttaaggtctcttgttttcaagccataaatagtattaaatttctttcatatataaaagaactaaattccttgtgtttaatttccattattctttagtacacttagtgtttcagaaatctgtattctattagatatgatggtttactgacattatgtgatctaaatgctgcatggcaatatggtttatctgcaaatactgtgttgtcatctagtaatataactatagttagttttatatatattttagttctttgagaattaaatatagccattggaacataacttataagatatagtttactaagctggcatttcataaatctaatatataatttacagtcttgtgttcaatttacaagcaaatatacaaatccatccaatatcctactaaaatgctagttgcattttaattctgttaagacagtgtcagattttccacatatgcttgcatgaggaacaatgaaagtatgtgtgttccaaacaggaagtgactttttatgatttgtttacattttatttggaaagatttttatttcagagcaaataattatttaaaaggccttattcttcagagggctacatacacagataaacattaaaagattatttttatcaaatctctgtagttttaaaatgttctttcctcttgggtagtgaggaacttgttacaaagaaagtgtctcctctacagaaaatatttaaaatacacttaagaggacaaaagagtaaaatgatccagttttgtcttctgagtgtggtggacatattataaaggctatatattgaagccaataaaaagcttgaagatgctatttaaaaatattagagaatgtgaaattgaaatatcaacatagtgacccttgttttgtcagtattgcttgaaaactccatacttttctgtaaaattcatagtgtttactatatcactgcaactgattcttagttggtcagtgtataatttaacagaatattctaaatacattttgagtcaaattattacttacccagtcataaagtctttcgatattggagtcaggacaatccatgcatcaaagcccctttgaaccacagccttatataaatgtctgcattttctggcttgattttaagttgacagtcaaaactttttgcagtcgtgattatttttacagatacagccttggcacttttttcctattttcttattttgaagatgaatgtgatggacttagtttaattcctctgaacatttttccccatattaaaaaactttgtttatacaggataggcattttggtggtatgtgaacatatatgtttgatttggatggcaaataataaaacctctctcatctcaaaaagaaaacagacttgaaaaatgataggactagttttcaaattaggcagaatttttttcatgtggttatgattttttgaacacatttaatccagaaaaaaagttattgcaaaagtgcctttttctctaaaagataaaacactcatgtatgtgaagtgagtgaaatttggttggcattttattatatgtcttgtgactaaacacagtttcattatcattatatatagtacatttctgtacttaaccaaatttctttttctatgataaaaatgtagaatttataggtctttgaacaactatgacatttaagtactaatttctcctattaactctactgtgtgccattaaatataaagttagttcagtaaagcaatgctcttttaatgcttccttaaatcctttctagagcaaaggcacagatttattacttacgtgcattaacttacaatattaagaaaggtgtaaaaactctttacatcagaatgaattaacacactgagttctccagggactcatgacgtgaatatatacattaacacacacacacacatacacatacacacatttacatacacaatacatgtatctactcattctactgaaaagtttggttttgcttggtacttttcttaattcaacagtattttactgcattctatatagatttgttttaaaaatctaccctgttgatataaggtccctccttcatattattataggaaataccatccctttcaatttcctgccacaagatgtttccatataaatatagtatgtgtattaatagggctgaatcaccctctgatttcagctgcattaacattcatgtcacaagcctcatagcttgaggtctggtacattgacagatacgcataaccttactccagtgccacaaattcgttaaggctgcttccaagctagttgcagtctcaatttctttttgatagtggactaaccaggcaatttgttcaggaaaagttttcagcaagctgaaagaaaattctgcctggattttatatttatttccttcatgttgcctaagaactatctatatagttctattgtggtaataagcaatacttttattttagaaaataaaagagtaaattgtaatgtaaatggcaacaacaccttgtgatgggttaaacagataagaaaactcactgattgtcagtctggagaatgttgtttactactttctacatatttcaaatactgggaatatagttttctacatttggacaaacctaaacatttacacacagaagcagaaatacaggcttttgccagactggggctcatattttagaattcacattacttttataagctcatcaccattttataaggtataataggaattaattaaaaatttgttctttttatctgtcttgttataatttagtttattctatgaatttaagattttagtctcatcacttaacataaaattaaattgtttttctggtttgacagcatttattcatggcactgtttagggtaaccagaaacaattaagaacaaggaagaaatttaactaatggtccacaaggggggaaacattgcatttacattcatagtcatgttctagaagacaagcttttctgacaaaaagttcataggtaagcagtgaaacatgtcataaaataaacaagattcaatttaacaaatcacaaatggactatttctatcaaaatgggcttaatctgggcttaattacctattgcagtgtgtgagtaataggttttagggagcccataaattattagagatgtttttctctagaatcctatagaagaaaaaaatcaacttgccatcaccctaaatgccattcttaaactctatattttatcagattaccttctctcctcaagaaacattgatgtataatgaaattttgatatatccatttagaatgagttctaggaatatgtctttttactcttaaatgagatacgtagagtttgaatactgagaataattcttttaaggtttattttaaattaataacatgttgtttgaatttcttataatacaagtttatatcatgctaatttgattcctaaggctgcagtgctccttatggtagttcttaaatatatttctatttttaagcagtgcagatttttaccaagaatcaatcaggtaaactggcagaagaaaacattatacttaagttaacattactaccattatacctactgtcttgaacactaaaaacaatttatgtgctaaggtaaactggcagaagaaagcattatacttaagttaacattattaccattatacctactgtcttaaacactaaaagcaatttatgtgcaaaggtaaactggcagaagaaagctatatacttaagttaacattactaacattatacctactctcttgaacactaaaagcaatttatgtatgacatggtacagtgaaaaatggacttgggcaacagttaaaagtttcatggcctatttcaaattctgtcagttattagctgtgtaacattgaggcaagttgtttagcctttctgagactcaccattttgttttcagcaaaataagaataattacaaattgccctgtaaatctcaaagaaagtttgaaaaggtcaggagatatattgtatgggagtaaattattagtattttagaccctcggccatttactaccctaacatgtttctacatcttctcctttactctaacctttctttagggatgaaaaaggaaaccttccttgtgaagacctcagaggacatatggtgggcaagccagtgcataagggatctgaatcaccaaattcatttctggatcaggaatatcgaaagagatttaatattgtcgaagaagatactgtcttatattgctatgaatatgaaaaaggaagatcaagtagtcaaggaagacgagaaagcaccccaacttatggtaagagttcttcttttatgtttatataagactatatttctggcataggaatctcaatttcctttaataagtttttgggttgtgagagttacttaggcgcttttgaatctttataattgatctgtctctctcatgtgcttctaagtggaatttctacaatatgagacattatattaaaaattattctagattttcaaaagataagaaagaacagtaggtaacattgtagctcataatgatttataaaaatctttttagcatcacatgtatttcttgtgtgttagatgttgccagtttggaaaaattcaagtgtttttttattcttttttgtttttttaaatgaatacttactgttaacatgacttatttaaaataaaattatctccatattcctcagggattttaagaaatataattttctcgagaaattctcacctcagtttttgtattttttaaagaagctgtgaaatttatttgacattagagtggaagtggattttaaatagaatggattgaacatactgtatttaaggcaaaaatgggcttagagttatgatgggcacaggattgttttaatctttgattcatgaccgaaaaagtaacccagtcacaaatacttaaaattgttatagtatatctgaaagatttgcagataaagttgcttaaagtagtcaagcttgtggttcttctgcaagaataaatggatttaattgaaagtctctgctcctccctttccacttttcaaattaataatttttagcgaggagcttatactttgaggaaggacagcatccctgctaattagttcaaacttgatcaatgggagctgagcagaagcaaagttgtttttagctcctccattctattcctacacctcacttgtctgtcatggccatatgcctccctcctttggtctcaaaagagcagtcatcacatatcttcatatacatgtcttatttcctttcagctctttggtaataagtatgaaagaaaaattttccccaaaatgatgctaaagaataggaaccatacttatcttaccttgtgttattctctgtacatgtgctttttaatcataagaataaataatatattttaacataaactcctcaactacactactctagtggcaattaaactgttaagtattgaagatatttgaacctttacttttctcctctactatattgtaaacctacaatatagagtatagaggcctgtaatctttgctatccctacccttgccccatgaaataatatgaaattttttttcttattcattcattccacaagtactaattgactgcctattaccaaataggcagtaatgtatgtcaactcttctttctttgtgtcccagtattatctggctattttctacttgtgttgaagtagataattaatgtttaatttaagagaaattatagtcaccaaatgaaagtgattgattactgatgactttattttaaaaaatgtttactaagttcttactcgaatggctataaattggtagtcccttcggactacattttaaagcccctaatgccatcatgtgccacaaatctcccccgactagaatagaatactttttaaatattagaaaatttagatagcctataaatacttgacatctttttgtaaccaacttaggagaaaagaaatatgtacatacttaaaagagagaagtaagcagagttatttgtttcattcagtatggcttttaactttctaaaattgacacataataattgtacatatttatgggatacagagtgatattttgatacatatatagaatgggtaatgatcaaatcagggtaattagcatattcttcaccttaaacatttatcacttctttgttctgggaacattcgaaatcttctcttccagctgttagaaattatataataaattattgttacctatagccatcctatagcaccgtagaataccagaacttaacttctctcatgtagctgtaatttatatccattaaccaatctcttcaaaatccctctcccactcacccctcccattctcagcctccagtaaccacagttctactctctatgagctcaaagtttttagttcccactcgtgaatgcaaacatgcagtatttatctttctgggcctgatgtattttacttaacataatgtcttccaggttcattcatgttgcagcaaatgataagatttcattcttttttagagctgagtaatattctgatatatatatatatcacattttctttatccattaatctgttgataaacacataggttaattttaatatcttagctattgtgaataatgctgcaatacacatgggagtacagatatctctttgacatactgatttcctttcctttggacctatacccagtaatgtgaatgctgaatcgtatggtagtcctgtttttagttttttaaagactctccatactaattactataatgacggtaccaatttacattctcatcaatattgtataagagctcccttttctctgaatcattgccagcatttcttattttttgtctttttgttaataaccattctaattggggtgagatgatatctctttgtggttttaatttgcatttccctaatgataaacgacgttaagcatttttatatagcagttggtcatttgtgtgtctgctttcacgcaatgtctattcagatcatttgcccatttttaaataaaaatatttcttttattgctgttgagttgtttgagttccttgcatattctggatattagttccctgtcagatgaattgtttcctttgctctacataagacttttagtttgatataatcccgtttgtctgttttttttcttttgttgcatgtaaaccttagccataaaaatatttgcctagaccaatgtcctgaagtatttcccctgtgtattcttctagtagttttataatttggggtcttatatttaagcgtttaatccattttgagttgattgtgtacatggtgagagatagggttctagtttcatttttctgaatatggatatccagttttcccagccctatttattgaagaggctatcctttgcccaatgtatgttcttgttgcctttgtcaaaaatcacccggctgtaaatacggacttatttctgaatactccattctgtttgattgggctgtgtgtctgtttttataccagtgcaatgctgatttggttattacagctttgtagtgtaatttgaagtcagtcagtgtgatgccttcagctttgttctttttgttcacaaatgctttggctatttggggtattttatggttccatacaaattttggattttttttctatttctgtaaagcatgtcattggtattttgacagggattccattgaatctgtagattgctttgggtagtatagtcattttgacaatgttaattcttctaatccatgaaaatgtgatgtctttccattttttgtgttctcttcagtttctttcatcagtgttttgtagttttcattgtagagatctttcacttccttggttaactttatttctaagtattttttgtagctattataaaggggattgcattcttgattttttttcagatagtttgttattggcatatagaaacactactgatttttgtatgttgattttgtatactgcaactttattgaagttcttaatcagttctaagagttttattgtggagtctttaggtttttctatatataagaacatattgtctgcaaacaggaacaatttgactttctcttttccaatttgaatgccctttatttctttatcttatctaatttctctggttagcatttccagtactatgttaaataggagttgtgaaagtgctcatccttgtcttgttccagtttttagagaaaaagctttccacttttctccattcaatataatgttagctgtgggattgtcatatctggcctttattgtgttgaggtgcattgctttctaatttgttgagagtttttatcatgaagggatgttgaatgttattaagtggcttttttgtgtatctattgaaatgtttatatggtttttgtcctttattctgttgaggtatcacatttattgatttgcatatgttgaaccatccttgcatctctgggttaaatctcatttgataatggtatacaatcttttttatgtattgttagattttattttctagtgttttgttgaggatttttgcatccatattcatgagggatattggtctgtagttttcttttttagttttcttcttgttggattttagtagtaggctactgctggcctcatagaatgagtttggaagaatttcctcctctactattttttcggatagtttgagaatacttggtataagttattctttaaaagtttggtagaattcagcaatgaagccagcaatgaagtcatctggtcctgggcttttctgtgttgggatcatttttattactgattcaatctcattactagatagtgatctgttcagtttttttatttctccttgattcaatcttgatacattatatgagtccaggaatttatcattttctctaggttttctaatttgttggcttgtagttgttcagaatagtctcttatattcctttgtattattgtggtatcagtggcaaagtttcctttttatgtctgactttatttgggtaatctctgttcttagtctggctaataatttattttgtttacccttcaaaaaatcaacttttcgttttgttggtcttctgtaggttttttttttttttgtctctttcatttagttctgctctgatctttattatttcttttcttccactaattttgagtttgatttatttttgcttttctgatttctttttttcctaattttttgaagtgcaatgttggagtgtttatttgaaatctttctgcttttttgatgtaggcatttcttgctataaacttctttcttagtattgcttttgctgtatcccataggtttttgtatattgtatttctgttttaatttgcttaaattttttaatttcctttttaatttcttcattgacccattcgttgttcagaagcatattgtttaacttccatataatcgtacagtttttaaagtttctcttactattgatttctagttttatttcattatgatctgaaaagatacttgatagaatttcaatttttaaaatttgttgaaacttgtggcctaacgtatggtctatcctggagaatgttatttgtactgatgagaagaatgtatactctgcagctgttgaatgaaatgttctgtaaatgtctgttaggtccatttagtctatagtgcagtttaagtctgacatttctgtgttgattatctctctagatgacctatctaatgctgagagttgggtgttaagtccatagctattattatataggggtctatctctccctttagctctagtaaggtttgctttatatttctgggtgctcctgtgttgggtacatatatatttacaactattatattcatttgctgaattgattcctttgtcattatataatgaccttctttttacagtttttgacttaaagtttattttatctaagtatacctactgatgcttgatttggtttttgtttgcatgaaatatctttttctgtctttttactgtcagtcggtatgtgtctacaggtgaagtgagcttcttgtatgcagtatagagttgggtcttgttttttttttttttttctttaatccactcagccagtctatatcttttgattggggaatttaaaccatttacattcagggttgttactgataggtgaggaattactccttcatttaggcaattgttttgcttattctttgttgctttcttctctttttgttttatctttgcagtttggtggttttctgtagtgataaggtttgattcatttatctttgtcatttgtgtttctactctaccagtgacttttattcttttgtgtgcttccatgatggaaattactgtctttttgcttatagatgtaggattcccttaagtatttcttttaggcctggtctagtggtaatgaattccctcagtcttttcttgtctgggaaagactttatttctccttcattgctgaatcatggctttgctcgttgtagtagtattagccaacaatttttttctttcagcactttgagtatatcatcccattctttcttggtctgtaaagtttctgctgagaaatccactgttattctgatggaggttctttttatgtgatctgacacttttttcttactgtttttaaatttttttctgtgtctttgacttttgacaatttgaatataatgtgatttggagaagacttttttgggtttgaatctgtttgcggttctttgagcttcctgtatgtttgtatggtatatcgcttgcaaaacttgggaagtttttagctcttattttgttaaatagtgtattagtcagggttctccagagggacagaactaataggatatatgtatatatgaaagggagtttatgaagcagaattgactcacacgatcaccaggtgaactcccacaataggctgtctgcaagctgaggagtaaggaagccagtagtggctcagtccaggtcccaaagcctcaaaagtggagaagccaacagtgcggacttcagtatgtggccgaaggcctgagagccactggcaaaccgctgataaaagttcaagaatccaaaggctgaagaacctggagtctgattcaagggcaggaaccatctagcatgggagaaagatgaaagccgaaagactcagcaagccagcttattccacctccttctgcctgctgtttctagccatgctgacagccagttggatggtgccacccacattgagggtgggtcttcttctcccagttcactgactcaaatattaatctcctttggcaacatcctaacagacataccttgaaacaacactttgaatccttcaatccaatcaaattgacacttaatattaactattacaaataggttttctatgcctttgcccatttaatttacttctggaacacttaaattcaaatgtttggtcactttatggtgtcccatttgtcatgtagagtttctttattcttttttattcttttttctttcttttatctctgactggattatttcaaaagacctgtctttatattcagaaattccttcttaagcttgatctagtctattgttgaagttctcagttgtatgtttttatttcattcattgaattcttcagttttaagatttttgtttggttcttttatatgatatctatttttgttgaatttctcattcagatcatgaattgtgttccttattttgttgaattgtctgtattttcttatatctctctgagtttccttaagatcattattttgaattgcttttcaggcatttcatacagtttttttttcctttggtgtatattgctagagttgtgttcctttggaagtgtcatatttccttactttttcatgtttctcatgaccttacattgatatctgtgcatctggtgaagcagtcacttctttgaattttgtgggtttgctttcacagggaaagacatttttctgcatttgcattctatagtgtcaattgggtagggtgctttgtttgggttgtgtgtgtgtgcacagtagtgtaatctccatatgatatctttgtctatagtcactcttgtattctccaaagttttttttttaacttttgaaactgaaacaaatataaccttaatgtagatacttgtagatacttcactggagattcctcagtacaagaactgaagattgtttcaagtaaataacagtttaatgtatttacctttttaaaattaaatgttaaataataaaacctatatgtcaggcacaggactgtgtggccctaattttcccaacaatttatttgttaagtcattcaactaatacttgtatacataaagtcagccagccactgggacacaaaaatgaataaaaccataaatcctaattacccaaagggaagaaacaaataaatagatgcatcacagtcacttcaggtaagttggaaggtgtgcaccaagtgctgtagtagcctaggaaataaagtctcatagtttgccttggaagtcaaatgagtacacatgacatttatgctgggttttaaatgatgaatagcgatttcatccagggtttttaaatgctagtcatcccaccaaatacctggtaccttctcaagcctatgtctgagatctgaagatttgtctaaatatctcagcccagaccctaacgaccccaacagaaataacttcaaaccttcataagcaataatcaatgacaacttttttatttaacctataaaatagtcccattacctggactcccaagtgcgacaatattatcttgtatttgaaaataatgataacgaaagtatgtaatcctgcttaaatatattgtttaaaaaaaaactaaagtacaaaaaactacatacttgacattttctggaaataatggtaatttaatctcttagcacttgtgtgataccttaaaatgcactatgtaagtcttttatccttagagtgttcaatttctgttcttggtcacaaaaacccttaccttgaagtatgtgaatttagctaccacttctttcctattaacttcccagatcatctgtttactcaaagagactttagagttaagattataagaatatgggtaggattttgagaagcaaaagcgatatgacacagttcttcatatgtgctttcagttgaatgtgtatgtagttgctatattttccttgtacattcatattctaaatttagacatctaatagaaaaatagggacactctgttattaaacacagtgacaaagaaacacagatgtaaagaaaaatatttgaaaatatctggttgttttttttttttgagatggagtcttgctctgttgcccaggctggagtgcagtggcacgatctcggctcactgcaacctccacttcccgggttcaagcgattctcctgcctcagccttccaagtaggtgggactacagatgcacgccaccacgcccagctaatttttgtatttttagtagagacgtggtttcaccgtgttggccaggatggtctcgatctcttgacctcgtgatctgcccacctcagcctcccaaggtgctgggattacaggcatgagccaccacgcccggcctgaaaatatcttaatagtagcttttaaagtatgttatttaacgaagattcttatgttataccatggaccctctagttgttaagaatgagttaaaagaagtacaggtatttaccctaagcaattaaacaaatacagtatggactgacagtagatggcatttctagaaaataagtaaatacaataagccctcatttaacatcatctacaggttcttggaaactgggactttaagcaaaatgatgcacagctgatcccaatgccatttccttcaatatcattttgttataacaatgaggaagaagatggttttgtaatctgtggtttcactttaagtcccagtttccaagaacctagagacaacattaagtgaggacttactgtaatacctgttgagcgttcaggtatgccaaacacagttctaagcatttaaaagcattaatctatttaatcctcacaacaactctatgaggtatgtactaataaaatatttgttttacagatgagaaatctaaaaaacagaaaggttaaataacttacccaactagtaagtgatagagctaggattaagtactcatggatatttttttgacccttaccagtggtaatgctagctaaatgtgatgaaaataattttttaattgtaggtaaataatttccaaaaattacattcctcgttctaaattcaagaatttgattccagcaagcagaaccaagtctgattttatatgttcttgtgtatgttgttttggatttactaacactataacgagcatgcatttacatagatatgaacctgacaggccttaggaaaagactgctaaatttagatgtaaaatgagcaacaatgtgttatgtcctttttaaatcagagagtataaaataggtttactttcctaaaaagatagacaggaataacttatggaaacatggataccagtagcagaagcaatctagattagtagttactagcattggctgtagcatcagccatagttggtaattttgtctgccatctaattattccagtgtgaccttggggatgttactctgggcctcagttttcttattaaatgaatatgataatatctgccttgtagagttttgtgagatttaatggtaagacattgtaaattgcctcagtgcccagtatgttgggtctttgttttcattattatcattattacatagaagctttaacatggaaatagaaacagggaaaaggtggcattaaatcattttaactatatagggtctcattgctcaggcttcaaaggcaaaggcttaaatttgatgagatcagttgcttggcaacttttcaaaatggtaatatttcccatcagcttttccatcttgctgtacatggactccttgcccttgctatttcatcataacacatttctatgcatagaaacatgctaaaaggtagacacagttggctgagtccctttgtggccatgaatggtcatattttataagaataggaggaaaacatatcttttaacaataatatcaccaaatagtattggtttgaaggtaggaatccagaccttttctgatttattgaaaatccaggacctcacaaaaagcacaggaatgaatgtaaagctgatattttagaaattatcctcataaatgttacttgtacacattgtgcattgaggaaaattaatctctgtaacattatacctgaacattttctacctgagtagttgggacaagagaaaatcaaatactatgtcctttttatccacataaatagcaaacggcttgagtgacatatagcagtatgatgaagggcctatgggcaatgacatcataaactgagttttatcaatgtgaagttaggatagcgtctgtaggttccagggtctctctgtcctgtgattttaaaatgtaaataatcttccttatcaggtaaaagttcagctgtcattaatcagctattctggagacaaaagaaaataggattctacccatgggaaatttttgtgttcaagtaaaatgtacgatttccaaagaagaactaaccacagaaatagaaattagtgattcaaagatgaagaaatgtgggatgtgcactatattcatgggaattcttattcctttagacttatttaataaagttcataaagactacatgttggttagcctcacaaaataatttttagcatcaagctgatggtggtaaggaaccatgtaattgatggaaaagcagttcaacaatattttgacatagaaagtagtctgtttctattgtaaaacttggagaaatcgtctaaggaaggcattcttcctgaatttgtgcaattttactgatggaaatggaagagcatgaattatgaggtcaaatagacttgaatttgctatcacagcttggcttttaatagctaattgaccttgagcttcagacttaacctccctgtatttttgtttccctgtctgtaaaatggaatagtaatattactcatggtgtttttttatgaggattaaattagataacatacgtcaaatacttagaagagttcttttttttcttttcttttctttttttcttttttttgagacagggtcttgccctgttacccagtctgtagtgcaatggcatgatctcggctcactgcaacctccacctctcgggttcaagcaattctctgcctcagcctcctgagtagctgggattacaggcgtgcatcaccacgcctggctaattagcagagttcttgcctcatagaaagtactcaagaaatgatgccttagatggtataataaatgcttgctgctcataaataaaaatgtcccaaagatttttcaagtctcctgtggaaggacttagttagtaaaggacaaagtatctagaagtctttccacatgtttggtcactctaccaagccaatagctggccatttaaattatagcagttaaatatgagtagagctttttggtttcttttggtttgattttgcaaaccaaagcagaaggaagatctttcaaatagttaataacactgcaaactgccctcatccaaatcctcttaagctccagtataaaaatcatcagctcacatgctggattagaagggcccagttataatctctcagcgtcaggaatctgaaaacagttcagcccccacatctttttaaagtttttgattagttgcttaaaaaatggaagaatagtatattatataaaataaataaaatggttggagagccttaaagaaattaaacctaggaagaaaagattattctgaaagaattcaaggtactaggtaatggataaaacagtaagattaagaaaaagaactttcggtggctggcaagatggccaaataggaacagctccagtctgcagctcccagagggatcaatgcagaaggtgggtaatttctgcatttccaactgaggtacctggctcatctcactgggactggttagacagtgggtacagcccgtggagggtgagcagaagcagggtggggcgtcgcctcaccctggaagcacaaggggtcggggacctccctcccctagccaagggaagccatgagggactatgccatgaggaacggtgcattccggcccagatactacgcttttcccatggtcttcgcaacccacagactatgagattccctcaggtgcctacaccaccagggccctgggtttcaagcacaaaactgggcgactgtttgggcagacaccaagctagctgcaggagttttttcctaccccattgacacctggaatgccagcgagacagaaccattcactccctggaaagggggctgaagccagggagccaagggatctagctcagtggatcccaccccgacagagcccagcaagttaagatccactggcttgaaattctcactgccagcacggcagtctgaagtggacctgggatgctcaaccttgctgggggaaggggcgtccaccattactgaggctttagtgggcagttttcccctcacagtgtaaacaaagcctctgggaaattcgaactgggcggagcccaccacaacctcggcaaagccacggtagccagactgcctagattctcctctagattcttctagtttcttcctctagattcttcctctctgggcagggcatctctgaaagaaaggcagcagccccagtcaggggctcatagatagaactcccatctccctgggacagagcacgtgggggaaggggtggctgtgggtgcagcttcggcagacttaaacattcctgtctgccagctctgaagagagcagcagatctcccagcacagcgctcgagctcagctaagggacagactgcctccttaagtgggtccctgacccccatgcctccttattgggagacacctcccagcaggggttgacagacacctcatacaggagagctccagctggcatctggcaggtgcccctctgggatgaagcttccagaggaaggaacaggcagcaatctttgctgttctgcagcctctgctggtgatgatacccaggcaaacagggtctggagtggacctccagcaaactccagcagacctgcaccagagggacctgactgttagaaggaaaactaacaaacagaaaggaatagcatcaacatcaacaaaaaggacatccacacaaaaacctcatccaaaggtcaccaacatcaaagatcaaaatagataaatccacgaagatgaagaaaaaccagcacaaaaggctgaaaattccaaaaaccagaatgcctcttttcttccagaggatcacaactcctcaccagcaagggaacaaaactggacggaaaatgagtttgacaagttgacagaagtaagcttcagaagatgggtaataacaaactcctgagctaaaagagcatgttctaacccaatgcaaggaagctgagaaccttgaaaaaaggttagaggaattgctaactagaataaccaatttagaaaagaacataaatgacctgatggagctgaaaaacacaacatgagaacttcgtgaagcatacacaagtatcagtagcagaatctatcaagcagaagaaaggatatcagagattgaagatcaacttaatgaaataaagcgtgaagacaagattagagacaaaagaatgaaaaagaatgaacaaaggctccaagaaatatgagactatgtgaaaagaccaaacccacatttggtcttgtttggtgtacctgaaagtgactgggagaatggaaccaagttggaaaacactcttcaggatattatccaggagaacttacccaacctagcaagacaggccaaattcaaattcaggaaatacggagaaaaccacaaagatactcctcaagaaaagcaacgccaggacacataatcatcagatttaccaagtttgaaatgaaggaaaaaaaggttaagggcagccagagagaaaggtcgggttacccacaaaggaaagccaatcagactaacagcagatctatctgcagaaaccctacaagccagaagagagtggggggcaacattcaacattcttaaagaaaagaattttcaacccagaatttcatattcagccaaactaagattcataagctaaggagaaataaaatcctttacagacaagtaaatgctgagagattttgtcactaccaggcctgccttacaagagctcctgaaggaaacactaaatatggaaaagaaaaactggcaccagccactgcaataatatacaaattgtaaagaccatcaacactatgaagaaactgcatcaactaatgggcaaaataaccagctagcatcataatgacagaatcaaattctcacataacaatattaaccttaaatgtaaacagactaaatgccccaattaaaagacacagactggcaaattggataaagagtcaagacccgtcagtgtagtatactcaggagacccatctgacatgcaaagacacacatgggttcaaaataaagggatggaggaatatttaccaagcaaatggaaagcaagaaaaaaaaagcaggagttgcaatcctagtctctgataaaacagactttaaagcaacaaagatcaaaaaagacaagggcattgcacaatggtaaagggatcaatgcaacaagaagagctaactatcctaaatatatatgcacccaatacaggagcacccagattcataaagcaagtcctgagtgacctacaaagagacttagactcccacacaataataatgggagactttaacaccccactgtcaatattagacagatcaatgagacagaaaattaacaaggatatttaggacttgaactcagctctggaccaagcagacctaatagacatctacagaactctccaccccaaatcaacagaatatactttcttctcagcaccacatcacacttattctaaaactgaccacataattggaagtaaaacactcctcagcaaatgcaagagaacagaaattataacaaacagtctctcagaccacagtgcgatcaaattagaactcaggattaagaaactcactaaaactgcacaacaacatggaaactgaacaacctgctcctgaatgactactgggtaaataatgaaattaaggcagaaataaataagttctttgaaaccaatgagaacaaacacacaacgtaccagaatctctgggacacatttaaagcagtgtgtagagggaaatttatagcactaaatgcccacaggagaaaatgggaaagatctaaaatcgacaccctaacatgacaattaaaagaactagtgaagcaagagcaaacacattcaaaagctagcagaagtcaagaaataactaagatcagagcagaactgaaggagagacatgaaaaacccttcaaagaatcagtgaatccaagaggtggttttttgaaaagattaacaaaataaaccactagccagactaataaggaaaaaataaagaagaatcaaatagacacaataaaaaatgatgaaggagagatcaccactgatcccacagaaatacacactaccatcagagaatactatcaacacatttacacaattaaactagaaaatctagaagaaatgggtaaattcctggagacatgacaccctcccaagactaaacaaggaagaagctgactccctaaatagaccaataacaagttctgaaattgaggcagtaattaatagcctatcaaccaaaaaaagcccaggaccagatggattcatagccgaattctacctgaggtacaaagaggagctggtaccattccttctgaaagtatcccatacaatagaaaaagagggactcctccctaactcatttcatgaggccagcatcatcctgataccaaaacctggcagagacacaacaaaaaaagaaaatttcaggccagtatccctggtgaacatctatgtgaaaatcctcaataaaatactggcaaaccaaatccagcagcacatctaaaagcttatccaccacgatcaagtcggcttcatccctgggatgcaaggcttgttcaacatacccaaatcaataaacgtaatccatcacagaaacagaaccaatgacaaaaacctcatgattttctcaatagatgcagaaaaggcctccagtaaaattcagcaccccttcatgctaaaaactctgaataaaataggtattgatggaacgtatctcaaaataataagagctatttatgacaaacccacagccaatatcatactgaatgggcaaaagctggaagcattccctttgaaaactgacataagacaaggatgccctctctcaccactcctattcagcatagtattggaagttctggccagggccatcaggcaagagaaagaaataatgggtattcaaataggaagagaagaagtcaatttgtccctgtttgcagatgacatgattgtatatttagaaaaccccatcgtctcagtccaaaattgccttaagctgagaagcaacttcagcaaagtctcaggatacaaaatcaatgtgcaaaaatcgcaagcgttcctatacacccataatagagagccaaaccatgagtgggctcccgttcacaattgctactaagagaataaaatacctaggaatacaacttacaagggatgtgaaggacctcttcaaggagaactacaaaccactgctcaaggaaatcaaagaggacacaaacaaatggaaagacattccatgctcatggataagaagaatcaatatcatgaaaatggccatactgcccaaagtaatttatagattaaatgctatccccatcaagctaccattgactttcttcacagaattagaaaaaaactactttagatgtcatacggaaccaaaaaagagcccatatacccaggacaatcctaagcaaaaagaacaaagctggaggcatcacactacctgacttcaaactatactacaaggttacagtaaccaaaacagcatttactggtatcaaaacagatatatagaccagtggaacagaatagagggaggcctcagaaataaggccacacatctacaaccatgtgatctttgacaagcctgacaaaaacaagcaatggggaaaggatttcctatttaataaatggtgctgtgaaaactggctagccatatgcagaaaactgaaactggaccccttccttacaccttatagaaaaattaactcaagatggattaaacacttaaacgtaagacctaaaaccataaaaaccctagaagaaaacctaggcagtaccattcaggacataggcatgggtaaaggcttcatgactaaaacaccaaaagcaatggcaacaaaagccaaaatagacaaatgggatctaattgaactaaagagcttctgacaggaaaagaaactatcatcagagtgaacagtcaacctacagaatgggagaaaatttttgcaatctatccatctgacaaagggctaatatccagaatctacaagaaacttaattaaacaaatgtacaagaaaacagccccatcaaaaagtgggcaaaggatatgaacagacacttctcaaaagaagacatttatgtggccgacaaacatatgaaaaaaaagctcatcatcactggtcattagagaaatacaaatcaaaaccacagtgagataccatctcatgccagttagaatggcgatcattaaaaagtcaggaaacaacagatgctggagaggatgtggagaaataggaacactttgacactgttggtgggcctgtaaattagttcaaccattgtggaagacagtgtggcaattcctcaaggatctagaaccagaaatagcatttgacccagcaatcccattactgggtatatacccaaaggataataaatcattcttttataaagacacatgcacacgtatgtttattgcagcactatgcccaatagcaaagacttggaaccaacccaaatgcccatcaatgatagactggataaagaaaatgtggcacatacacatcatggaatactatgcaaccataaaaaaggatgagtttgccgggcacaggggctcacgcctgtaatcacagtactttgggaggcagaggcgggtggattgcttgagctcaggagttggagaccagcctgggcaacatggtgaaccctgtctctactaaaaatacagaaaattagccaggtgtggcaggatgtgcctgtaatcccagttgcttgggagactgagacgggagaatcacttcaacctgggaagcggagattgcagtgagccgagaccgttgcactccagcctgggcaacagagcaagactccatctcaaaaaaaaaaaaaaatgagtttatgtcctttgcagggacatggataaagctggaaaccatcattctcagcaaactaacacaggaacagaaaaccaaacaccgcaggttctcattcataagtgggagttgaacaatgaaaacacatggacacagggaggggaacatcacacaccggggcctttcgggggttgggggactaggggaaggatagcattaggagaaatacctaatgtagatgatgggttgatgggtgcagcaaaccaccatggcacgtgcatacctatgtaacaaacctgtgcattctgcacatgtatcccaaaacttaaagtataatttaagagaaagaaagaaaaatcacttttaataaagttcggtggtattcatatgtagataaaatagaagtattagcaaaccaaatcaacatagctgatgcaactatgaggggggaaaaaaacctcttcagatgaattaatcgaaaagatatgaactagatgaaatagtgttcccttataaacagaatgggaaagccaagaagagaaacagtctcactcagtgattctctgggttcagtattgtcccccaggggacatttggtaatttccggggacaattttgttgtcacatttgtggtggaaagttgctactggcatctaatgggtagagaccaaagatgctactaaacatcctgcagtgctcaggacagcacccaacaagaatgatctggcctgaaatgtctgagaaaccctggctaacttaagaatcaatttacaaataaattgaatacagaagcagatactagaaaatcaaagtcagagaccttgtatggcacagaggtgattgccttatatttttttaattgaaagaacctgggaagttactgccctggaaagatataccaacatttattcacagttagtatattctctggacagaagtattcatttaaggttgttagcgtcagggattacctagcctgttctacaatagataatctaatcatgacatcccctggagcaggagacaatacgtttatccctagtcgaaatccgaatacattttcccccatgagaaaaaaaaaaaaaactataataaatggtagctaggtaaagtttaaatagggctattcatgttagctttcagatcacaatatgacttaagtaatccagcgatttcctaagtacgttcttcagatcactagttctgaaagatagcctatggaagaaagaggttatatggttaaataagattgggaagttttacatattttaggcccctcttggagattaataaattcacattcacatactacatctttgaaagttttgttgaatttgggttaatttactgtttcccaaatgtgtttgtatattaaatcccttttttggtcacataatacttaccagcttcccaatggaactaatgttttatggaatgtattttggaaaatattgtaaaagacttttgcagctcttcttaaagacccaactaccaatgatacgatttctttgtgtcttaagttccaaacagctgacttacagataagcatatagaacaacctctgttctcaatatttaagcctgcccagcggttggattattgaatgtcatcttcattcttcattcttatcttgtagaaaagccatatgtaaactactttctagagtaaatcttatttatgatgaaagttcaaactaaagtaagaaaaactatctagaaagatcattacatggtgttctatacttcaagccacttgtggaattactactatcactgcaaaacaatttgccagaagtcatggaagaaatagatccttggggatagaaaatgtcaggtgtaatattcagtgttcaaaaagagataagtaaaaattacacactgaataatgactggagacattagagcaaataattaaaacagtatacagccatttaaaaatgtacatatgacaacttagcattgttttataagcaacacatcatgtcataccaatttatttgccatcattgttaaggtattggaccacaaacaaaaagttgcatccacagtttatgctgtaatcctccactagttcttcacatagccttagtattttgcaagagttgcaaactggctgtgaggacacttaaacaaacaaaaaaaaactaatcatacatgccattaaatttttgaagaaaaattaattggatttttgtctaatgtaatggtcttgaatgatacatcactgaggcaatttgatgtagtgaaaagaggtctgggataggaacttgaaagtctgtattcatggactgactctaagtgtttattaccctgaaacttctttagttttttttcactgaatatctgtgaaatcagattatctgtgaaatcagggagaggatgagggtgaagagtattaacctgtgtgctgtacttttacactccattgtcttctaattgtcttatttttgttctgtgaatgtgtccattagggtcctacattgtcaataaaagtgatgtttccattacaaaaaaaaaaaaactttggtctgtctgaagtttttcatctctacctttcttgctggcttcactaacaagtaatggtctcagaaaaataggtgaaaggaattgtaaagttattacaagatgtcatttattttcaaataagaatgttcaactagttaccttattatctttttttacttttcatgagagtgactgtcttccatatgctgataggatttgcaagacacactgctttactaaaatttttaaaactagactgctttaatttgcagttctttaacttgagaactgcatgcttttaaccaataatatttacatgcctgtgtcatctttcttgttcacatttatatcaatgctgagcacagcaaagagacaagtattttagcctagctcattttataccaaccagagccttcagagtacccagaactcttttgccacttaaacagtatttaaatcatctaaatcctttctcattcctcccacacccctctaatgtagagaaattgtctctatgaacagagacaacatttcaactatttcagctatttcaacagatttccaaactccaatgtgtatgtatagcttgttccctcttgtggtggaatacttacaaaaggtaatttggttcaaaatataattagccttggaattaggtgttagaagtgccgcataattttttgacgcagttcagtattttctcctttagcaattctttcatgttattccccatttaaagtatatatcacttttagaaagcagtaggaaaatacacaaccacaatggagcttattcttggaaatgatttttttaactttaagtttaggggtacaagtgtgggattgttacataggtaaacctgtgtcatggggttagttgtacagattattttatcctcaggtgtttagactagtacccgttagttgtttttcttgatcctctccctcctcccaccttccaccctccaaaaggctccagtgtatgttgttcccctctgtgtatccatgtgttctcatcatttagctcccacttgtaagtgagaacatgcagtatttggttttctgtttctgtgttagtttgctgagcataatggcctccagctccatccaggtccctgcaaacaacatgatcttgttcttttttatgaccacatagtattccatggtttatatgtgacacattttctttatctagtctatcattgatggacatttatgttgattccatgtctttgctattgtgaatagtgctgcaatgaacatacacatgcatatgtctttataatagaatgacttctattcctgtgggtatatacccagtaataggattgctgggtcaaatagtatttctgtctttaggtctttgaggaattgccacactgtcttccacaatggctgaaccaatttatactccaccaacagtgtataagagttccttttttctttttttccacaacctcaccaacatctgtctttctttttttttttttttactttttggtaatagccattctgacaggtgtgagatgatgtctcattgtggttttgatttgcatttccctaatgattagcgatgttgagcttttttccatatgattgttggcagcatgtatgtcttcttttgaaaagtgtctgttcatgtcctttgcccactttttttatggggttattttggaaatgagattttaactggttttgttctctgtcaatgaaactgaaaagattttaaattaatcaatacaaagtttatatttgatttgtattatttataagtcattaaaggtaatccttaaataatcctcacattgaaatgtttacaaaccaatttcttcagcctcttttatccagaaatgaaatttttaaaatatgcctataaagatcagatcgttcattcttattttactggatccagatatgttaccattatcctttaaaaattactgactttccatttaattcagttttacttcctctttaaatgtgtgattctctaccttaaataaccccaggatgttttcctagaaattcagtcagccatctgaaagtaatttttctgtctggtatgtggggtttttgatgggtgtatgtggcaagcatatagcttaactatactcactatactcattttcatcaaaatattggctaaaatattcagaacagatgtatatatgtgtatactttttctgagactctagagaaagcttttttgtgaacattaaagggcatgtcagacttatggagaaatttctttgaaaatttttttaaatctttgacaactgtaagagaagattgcttctcaggtgctgtttattaccctgaaacttaatgactttagcgtgcttttagagagtttttaaaagcgatacaaatgaaaaaggcagcaattcagtggtgtttcaacagacaacatgggaatgtatgtagataagaaatcaagagacagaactagttctgacttgattggcaaacagttctgtaaagctcagtttgtcagaaaaatgaagagtattggtgagggtaacatacttgccttagaaggaaggaagagggaggaaaagaaggaaatggaaaattagaaggaaggaaagggaaagaaactacgaaaatagaaactaatgatacagcttggatcctttttggtctagtgtctgaggaaagtcccctatttactttcttaacaagcagtgagttaaatattgagcagttactgtgtttaaggtactgcgctaagtgtgggagataccacagtagacagtagaaaagtctgtcttctcccatgaagtttacagtctagaagggtgacagaattcaagtaactaaattaataaatacttacgtgactataattgtcatgctacaaagaagaactttgagaggaaatgagacaaacacagagaatcctgacctagaatgagaggccaaggattgtatccctaaggaaatgacatttttgcttagctctgaaggatgcatgtgaatttatgataagaagagaggaaaatcagaagacagagtcttagggtgccgggtaaggaaagtgtttcaaggaaggagtagtactcggtgctaatgctacagatacatcagaaaagtcaaggactctgagaattgtgtattggatttagcaacatggaggccctaaaaaccttgacaatagcagttttggtggaatagtggggacaagagcttaatcggggaagattcaagaggggaggagaagaattgggggctacaaatataaagaagctttctacaaggttttctgtaaagagaaacaaaaaataaggtggtagctgggtagaggtttgtggggtgaggagagttactttttaaaaaacgattggagaaattacagcatgtttatatgctaatgggaatgactgagtagaaagagaaaagttgatgatgcaggagaaagaagggaggattgctcaaggcatgcccttgagtaggtcggagggaataggatccaatgagcaacccagtaatttcagatctccctaatgtcacaatacagtataataagtattgtatatatgctaaaggcactaggaaaaagcttagggagcccagtagagtgagcagttaactctgccaaaggggattgtagcatttgtgatatcacctaaaatgcttatctgaggtaaaaattagtttattttcaagcaatgttgtacactagcattaaagcatagcaattttgtattaaaatacagtaattaggatatatcattatacagcacttcatcattgtctatattcttaaaattgtattttgtgttacatttgcttaattgcgctgaatatagtccataattcttaaaaacctacttgccatcaatatcataataaaattcagacaaaatccaaaaaatagttatctttttttctgtgtgcctctataaaaatatttatcttttacctttaccacatttattagaatacaggaataaatacagcacaaaatttctgcctctatggagacaccaattaaaaaactctagatgtgcaacagatattaaaagccaaataaaataatggttatactatgaggcactagcacagtggtatcacaaggcttatgatagggtgccaaatgaactctgcaattaatgcatgctttatacttaaaggaataaaaaattaagaagtggtcagcaaaaatatttaaatgggccctaatcctcgttttctagattatattctttgctgttattattcttatcatgaattagtaatcttaactttacaacttcaaaaaccaatataagtactactatgtaaagatatgtcttaaacttttccagattacttttcagagatttatgttttatttatgttcatttacacaggaatgggtcagatgtatttaattttattaaaccaatccatttgtattaaagccttaaaaagtcatatgagtataaaaatactttgcatgtattaataatagcatatatttgatttaagtctataatgcttatagtactcttgcctttggtgttttgtttcacttggttttttaccaacagcactaaaacattgaatcatagatttatctttccatttgaactttgctgtcctgtgaaattaaaatgctgctgtatacatgcagtagcaaacatattttcaagctgtaatcaatgatctgtatatttggaattagaaataatttaagccatggtctatttttcagtctgccatggactgctatttatacaagaatgttaccttatgttattggtttaactgctttattaagtcgacttcagtatttcagcacaattaaaaatcaatacttataagcaacattatttgttctacctaaatcaataatatactttattttttaaaatacttatttttatttgcattgctgaatctatggttttataactaataaaagcaaaaccttgatgttctccaaaagtaaatttcagtaaagctttttctttcggtttttttctaatttagtatattttccttcaattgtgtattagtaatatacagtataattctgttaaaaaaaaaaagtcacccccggaaaagtcagtgttaaaaatcttctgcataattgtttctatggctaattatacaaccagacatatcaagggcttaattacatgcttcaatgacttagctccattaaaatttcagagatgacgcaaaatataatgaatacaattatgtatttcatattctgtgtgtgaagtatgtttcttcttgtttttgtgcacatatgtttgtctccaaacaaccaattttcaaaaaatatctaactagctttttaatatatataacatatagagcaagtgaaacaactgcttatttattggattttcacttttcaaaagattttttgatgacatgtaaaaacagtgctagagctgttaattgcttcagtttcagtgcccatgctgaagtagagtttatttctaaaaccagatcctaaagaaataaattgtagatattttgaaaatacagccttcataacattgaaaatctggaggactgactgtgcaaagtggtgggaatagacataacaaaaggagaccttccctcaaacctttaccctactttcgatgggcagaatattgacctggatctatagatggctgttgtgagacctcggttcttcttagcttaaaagaatttaaacaagagacacacagcaaaggagatatagtatagagcaatttattgcaaaggacaaagaatattatgaaagttaggttcagaacagacagtacaccctgagagaggattcagggtgagctgctcctaaggatgagaccaccaagactggcactagggagactccctttatgagagtcttacataattattcataaaggagtgggaagaggtgttgctattaagcatattcttggttgtcctctgggtgcacatgcatagtagctgtacatacttgttcatacattgcatgtctcattagcatcttaaatctctatccaggggtgtgttgcttactgttataatgaacaaagggtcggtctgaggacaggtgtaatcaaaatgcatgtgctccctgcaggggaaattccttactgtagatagctgtgtttgaatgagctggactacagtgtgagtgctggggcttattgtgttaactgtattgtcgccatgtgaggacatgtttacttccttgactacctatcctgcctcagatcatctcactcaaattccctctgtgtaaaagagcagagatatactgttggagaatttggaatattaggtgatcatttacaaagttgtttgcataccttgaaaggaagccattaaataaatattacatttttggctcattaataattttatcatgtctagttaatcttcagattttaaaagagcttagcaaaacagactaaactgtatcagtgttcacaataaaaagccataagattgatactttttccttaagaacagaattagaattctcctgacagaattttttaaagcacattgagtgattttaataatcataaaatttagctgggcaaggagggaagctgcagggacagaaggtgactgacagatactgaaaagtggtatgacaggtattaatagattaaaggaggaagaattgttggagtactgtaggtagtgtgctagaaatacaaaaggtggtagttcgtaagctggatatttaaagggattgcagtctttgctgatgagactaagcatatgacgacaggaatgagtgtgagagagaacctcaagaaactgaaaggccagactctcagagggtgaatattgaagtcaccaagaattatgacagaagtgtgagtgcctgggtttgaatcctgatactatgtacttaccaggtatatgtccttgggcaagttatataaccttagtttcctcatcagttaaaatgaggataatgatagtatagttctctgaattatcaggagtaaacaatttaatacttatgaaactcttagtatgtggtatatggcaaatgacatataaatgtttataatattatcagaatcataataaccattattatttgtatgatccagtcctgtgtgagtctccgcttttcattcactagaaatttattaagcgactatttcatgccaggcattttgctaggtatcctgttaaaacttctgaattattttatttggctgttttaggcttcaggaatttcaagtggaacagaaataatatactgcagcctcaccaaaataaaagttattcttgaagtctttgccatgagttctccttgctgaattaaaatgctgtttagtaaggatacagacccagggggaaatggagcaaaccaaagcagtgattacttggatctctatactggacaggctcactgtagcaaaagagatgcttagaagcagactcagctgtaggacatgaaagagaatctaaccatatttttgaggcatggtggtgtccaaaatgtatggtgataggagatgggaagcagcgaagataaaaagttatccttgtggtgttccaacttgaaacagtgggttaatgtctggtagtcaggttaaacacagagagctaccattttggaggttggctgtcaagatatagacacttggatgttaggaaataagatagagatccagttactgagtaaaatcacttatatgattatcttctttaaaaaaaaaaaaaaaaaactatacccttaaagtctggggttcctaagagagctaacctaggctattcattattatttataaaaagtaccttaagtttgctttatcacctggccaataggcaatttcaccttctggctcaaaacacattttctccatctacacaaatgccaaccataatgttgcataagagtgagtgtgtttggtagactttagctaaaaatcagtgtaagtttgagcagacatggggaagaaaaacaatgtgatgtgaactttgttctctgtgtttaggcaagctacgacctatatctatgccagtggaatataattgggtgggggactatgaagatccaaataagatgaagagagatagtagaagaggtaagtgttctagaatttcagtgtaggctgggttgtttgaacaataagcaaatttaaatgttctgtaaatagattgttatggcttcagtggaaaacttattctatcattgactttattgtacaacaaaaccaagtaagaccaacatttgactatcttgacccattattaaacagatattgtctctgaatgccttctaaggggttccaggtacataagtatggtgttaaaagtaaatatctgattattatttgaaaggtaatatttggaacacaaggtcaggagtgtgaaactgcataaaataattaagttcagtgaataggaagagtttatcatcagtcctcatcggtctgcaatgcaacctcaccagttttgtatggaatcaacctcaaaatgagcattgaagcacatgggttaaaagctaatggaaactgggccagtgacttctaacaaaaaccatgtagaaatagaaaaaaaaaaaaccgtgcttttttttcctgttctgtttgctgctcagagttatcttcttacatgggggtgggctactcttgaaggatctaccaaaagtaagtttttatgttcacttatcctgctatagagatgagcaatagagagcaactgaaagtttccctactaaataggatttgatcaagtgtgggtatggtgggcccagtgggtcatgctgctactttgactttctgaagtagagagccgtaaggtcgtaggtggaaaataaaacaaatcaaaacaaaaaactattcatagaatgtaagttcactaagcttccttcatgatatgtttgacccgttttcttgttatttctagccagtatacagaatttattttattactgcacagatccgcagaccatatggacaagcaagcatgaatatctgattcattagtcttcttaatacttgttttatggagtgagcatttctgaaaatgttgataaatacaggaacattgacagattcctttatatctgtgtattcattccattttccaatcttcaatttctaatctcatttgttctatagaataaatcaagaaaagtataaaagagaaatgcttatcacatgctatctcagagtcactgttttgggacttcatattttagagacttttgttgatggggaggggaaccatgtgaagtactaagagctgactaccaatttaagcatagaattcctgaactaaatttcctgactattggttcttaatgtgggccttaacttctccaagcatgctaccttgcatgccacgggccggtgtttgttattgggctttggcaaaatccccatgagggtgattgttacaaattttataagccacacacctagaatttctgattcaagttccagaggtgattctaatgtagttggtccaaagctaaaacttggagaaataatctatcgactgtctattttttattgtcttatcataccaaataattaagatatactgtatttcactacatattttataagttaaatcaagttaaagttctgaaatgaaatatattagattggggcaaaagtaattgcggttcttgcaattaaaagtaatgggaaaaactgcaattacttttgcgccaacctaatagcacaattgagaaagaatggtaaatttggggtatttgtgtatttatattggtgtatttatctctttttatatagaaaactctctacttcggtatatgagcaatgaaaagattgctcaagaagaatacatgtttcagagaaacagcaaaaaggacacagggaagaagtcaaaaaagaagggtgataagagtaatagcccaactcactattcattgctacctagtttacaaatggatgcactgagacaagacatcatgggcactcctgtgccagagaccacactataccatgtaagtaaaatttcaaagactcttcaatacagcttttattggaagactggcaagtgactcttttgggtaaagtctaggttatttttatccttttactagattttcacaaaagagcctaactttaaagtttatgcccttaaaaaatgatgggtaattgatttttttcttaagtttatgtgttcaatgagttcatagttgtagcaagttggattttaatgggataacttaatatgcacaaaattgatggagaacaataataaatagctgattaatcatcagtgtgatactatgcaatgcacagatagctataaaattcaacattaaagatataattttaatatagtcatgattccatttaaaaatgaccatctattattttctagacatggagagtagggctagaggtaaaatgggaagacgtgagacaccattttatggggagaaagacatgctgagagtcccagtataacttaactgttgtgatgggtgggtgcagaaagtataagaggaacataggagaaatagagccttagtctttaggggaagtgagaaaaggcttcagagtggggagcatttgaatggagaataaaatatgagaagcagtattttagtgcgaaggcatatgcaggtgcgccacaaatgtgtgagaatgtggcatgttccaaggattttgtgtggcttatgattgctggtttattaacaattggaggaaatggcatgaggaaaggacagtagatgggcctggagtcataggtaaaggttagatgaggaactgtatgataaagtacttagtttctttcctgcagtaataaagagctattgaataattttgaactgggaacttgcgtgatcaaatcggcctattggatctctctagtgcagagcgtcatttgagagatcagaagcagggctattaagtccaggccatatggatgatgagaaactaggataatggccgtgtggaagctgagaatcatgttagcaagaacatttaatccacaaaattatgcatgttaaaccattttggttaaaaggagtttgttgtgtcactggaactatagcttcttattaggagcccttgaaaaacatggactgcaagtttttaagtaatttgaatgattgtgcttaatgcttaaaatatcaaaaaaattttaatctgcccctgctgtagaaggtatagcatctaggcattcaaaatgtgaaagatttaataacttacaattgagttgtttctctgagcaaatctcttaaatcatctacttattctatagctcttccataaaactagagtgtagaaaaatgtttttttttttggactatagtgttattagcactcctaggtgcctcattctttaccctcccttctccccagttacatactctcagaagtctctaagacactagtgcctgtatcagaatctgctccgttaaatgactgatcgattgaattattattttttccacagacattcagagtcagcctgaaatcagtactcttagtcgtttgaaaggggaccacttttgttattaccactattcagaagagctgtatgagcactgagcttcctctagaatctggtgttccagtcataagtaataccctgaacaaaagtttgaagatgagggacagatggcctattcgagagggtagttggtagtgagagatgaacctagagaaggaagaagagaccatcactttgactcagagtgtacaaattattaaaagtttggatttatcctgagagtagtgagtcattgaaggcacatttaaatactcagcctgctccattctgtcatgcatatcctgacagatgttatactgtgtgcggaaggaaagtagttaagtcttgtgaattatgaagtattaaattagggaagacagtaaaaggtgagccaaattggtaatcaggaatattgcgaatatttttgaggagtataaattgttaccacctttctgaaggacattgtttagttatgtatatcaagaatctgatctactaacttcacttctagaaatttattctaagaaagaaatcagagtccacttttgcctcctgtttttattatatgtcttgaatctgtaacatggtatttcccagatagttgacatctatctcaactaatttttgacagaggaccagcacagagtaaggaatattgttaactttgggggagatcttcccctataatgctgatacaccaattccagagtagaaggctgggtatttcctaactctgttctcaggtttagaagaagcaaaataatcgctaacccccaagtgcgtattggatatctataaccaatgttgtaaaagagagaactctaattggtggggtttttactaggctcttgagttcccttgaggatctcaccttgcccttatttagtgctttcacagttagcaaggaagtttccacatttgatatgtcttttgaacttcacagcaaccctatttgcaaataacaaaactcaaactcagaaatgatttacaaaagctgttttgcaaaaaaaaatacaagtactgttgtcaggactagaaccaaatcacctactccaggggtctttccgcactctatcctgttgctttgtgcatggtacacattccatatacagaggaatttgtgctttaatgaataaatgagtgcatttgaaaggcttgacttgaaaaaacatgtggccttgtatgatgatgttaataatgttttcagtgcctggattgatttcttttttgcttcatgttactatttgttaagttaggggaaacatactgagctgccgctgttataaaacacaaatagttatttagcttgatctattgctgggacaacagaatattatagttaacaatgcttggaccttggagacaaaacaacatacgcttaaataatagctttttatatttcacaggaatttctgttttatttttacctgtttatacatgcttatttaaaaatgaaaggcttttttcttatgttaaattttcctgaaaacacaatgtcagtatcaatctgtaatctaatcgctttcatgatgaaccactaatcttcatttttgccaattactcctttggataacatggccatgtttaatggaataggacttaagtggaagaggactatgaagattgagtattgcatttcataggcttctatctctgccgtaatactagctctatgtaatctaaagattttaagttaaaagttagagaaaatttagtatgaatttaatagcaagataatatcatcattaaatccccttaaacggcaaagtaaaggggtgtgtgcatgcatgcatatagtgttccttataagcacacctagagtatagtcttcactgttctgttgtggaaaacgtcccaataaaaatacacaaagcaagacaaatattgtttggcttcagggttcaactcattatcctataatgaagacttagaagtgtatgggattataaaatacatttttattaattccatatatctgatattctagttcatatatatttttcttaaacttatttaaaaggaaattattcactgtgctgtagctaccctagtcattgaccagctctttgccaccactttccttttcaacatgctattcccgctgctgagaatgcttttatctcttttttctcccaagaattcctgcctatctaaacctgaaatcacaaggacatcttccctgaccactaccctctgaactaaatcagttctcctattttctcttatcatccagtagtttttcttcaaaacctttgttgggatttttaattatatatttatgtgaacatctgcctagtgtctttctctcctgtacatggtaggacaggtatgcctatgttcatgatgataagcagggacaatttctccattttgttcagtactgtatttcagcacctagtacaaatgtagtaccttataagctctcaataaaaatgtcatgagtaagtgaattaatgagtgagtgagtaaatttgacaggaacttcagtggctttctcagtgtcttcaacctgcaaacatagccccctccatctcctaggtcaaccccacaggggcgaacaatgcaagaggattagctgccttacatcccctaccctacctccttcactccagctgaaaacttcagttccagctagttcttgcttgcttcctttccctgccatctcattacaaaggttccaatatgcccatcagccaagcatgttatgacatttttcaaaagagcataactttattttacctacttactgattctgtctgaaaatgtggaagctgttagctgccaaagccctcatctaacctgagagtacatgaagacaaggcagacagaagtttttgtgtggtgtgtgtgtgtgtgtgtgtgtgtgtgtgtgtgtgtgtgtgtgtgtaaaattcagatgtggtaagaaaagtctttaaagaataactgaattattctgaatctcatctttaaatcttgtaggacttatttttccccaatatgatgtgcatatgacaacttgctctcacattaaagctgctgaactaaattcatatacaaaataattacttaggccgagcacggtggctcatgcctgtaatcccagcactttgggaggccaaggcgggtggattgcctcagctcaggagtttgagaccaacctggacaacatgtcaaaaccccatctctacaaaaaatacaaaaattagctggatgtggtagcatgcacctatagtcccagctacttgcggggctaaggcaggagaatcactggaccctggaaggtctaggctacagtgagccatgtttgcaccactgcaccccagcctgggtgacagagtgagacactgtctccaaaaataatagtgataataataatagtcatttattttaagtctacatgctgagatgccagaacaagtaaaattggattatagattcaagcagtatgtaggtatactttcataaactgaatactgatgtaattttggatgattaaaaacagacttttagtaggtgttcaaaaatctggataattcctttcatgacattcaaacatttaggtggcctgtctttgtttttttaggatataactgcaaacattcaattgttttatgtctcataagtactttcagccactctggccaatttgtgaggttttgtggctttttttgatggagggaagaggggtagaactgttaaaaaacatttttatttttttttaatttagcaagtaaataaacattatgaaaatgctattctgattactttacaaatactatcttatttaaatctcataatgctgtgaggaagctcagttgctggtgttatcctcattttacagactagaaagctgaggcacatggattaattaggtagttatgtggtagagctaggatttgaacatttgcactctggctcttagcatactatattgcccctcaaaaaatagcataatttaacagaaacctaacaacagttgtatagtggcaaccacgtgtaaagcccagtctaagtgcagtggtatatacaaagactaatacaggcatatctcagagataatgcatgttcagttccagacaaccacaataaagtgaatattacaataaagcaagtcacacaagattttttaggttccctgtgcatataatagttatgtttatactatactgtagtctgctaagtgcacaatagcattatgtctaaaaaacaatgtacataacttaattaggaaatattgctaaaatatgctaatgattatgtgagccttcagcaagttattattattattattattatttttgctggtggagggttttacctcaatgttgatgtctgctgactaatcagggtggtggtagctgaaagttggggtggttatgacaatatcttaaaacaaaatgacaaagtttgctctatcaatttactcttcctttcacaaaatatttattagcagcatgagatgctgttcaacagcattatatccacagtagaacttcattcaaaattggggtcaggctctacttccaattctagttctcttgttatttccacaacatttgcagtgacttcctccactaaagtttagaacccctcaaagtcatccaggagggttggattcaatttcttctaaattcttgttaatcttgatattttgacctcctcctgtgaatcacaaatgttcttaatggcatctagaatagtgaattctttcgacaaggttttcaatttactttgcccagatccatcagaggaatcactatctatggcagctatagccttacaaaatgtatttcttaaataataagacttgaaatttgaaattactccttgatccatgggcagctgaatggctgatatattagcaaacatgaaaacaacattaaccttgtacatctccaacagagctcttggttgaccaggtacattgtcaatgagcagtaattttgaaaggaatcttttctttctgagcagtaggtcccaatgatgggcttaaaatattcagaaaaccatgctataaatagatgtgctgttttccaggctttgttgtttcatttataaagtacaggcagagttaatttagcatcgttctcaagggccctaggattttcagaatggtaaatgagcattggcttcaagttaaagtcatcagctccatcagcccctaacaagagagtcagcctgttttatggtttgaagctaggcattgacttctctcaagctatgaaagtcctagatggcatcttcttccactgcaaggcatttcatctgtattgaaaattctattgtttagtgtagccaccttcatcaatgatcttagctagatcttccggataacttgctgcagcttctccatcagcacttgttacttcaccttgcactttttttgttatggagatgccttctttccttaaacctcataaaccagcctctgctagcttccagcttttcttctgtagcttccttacctctctgatccttcatagaattgaagagagttagggccttgctctggattaggctttggtttaagggaatgttatggctggtttgatcttctatccagaccactcaaactttctccctatcagcaataaggctgtttcgttttcctatcatttttatattggaggccttgctttcagtatatcttggcttttgacatgccttcctcactaagcttaatcatttctagctttgatttaaagtgagagacgtgtgactcttcctttcacttgaacacttagaggccatcgtagggttaattaattggcctaattttaatactgttgtttctcagggaatagagaagcctgaggagaggaaaagagatcggagaacagcccattgggagaacagtaaaaacagacacaacatttattaagtctgttgtcttacatggcttctttctttaatcctcataaaccaacctctgctagcttccaactttgcttctgcagcttccttacctctctcagccttcatagaattgaagagagttagggccttgccctggattaggctttggtgtaagggaatgttgtggctggttttgatcttctatccagaccacttaaactttcttctgttttcttctgtgtcagcctgtcttttgaagctttgaagccaggcattgacttctcctctctagctatgaaagtcctagatggcatcatcttccactataaggctgtttcatctatattgcaaatgtgttatttagtgtactgttgttcatggcaccccaaaataattacagtagtaacatcaatgatcactgatcacagatcaccataacagatataataataaagaaaaagttttaaatattgtgagaattaccaaaatatgatacagagacacgaaatgagcacatgctatcggaaaaatggtaccaatagactcattcagcacaagattgccagaaccttccatttgtaaaaattgcaatcttcaaagaataaattgaagcacagtaacaggaggtatccctataatatttccactgctaatattactaatagctagcatttactgattacttactaagctccaatgctaagcacttaaatacagtatctcttggaatcttcaaaatgatcctatgaggttgatatcattatttctattctgcagaactgaaaggaactggaacacagaatttaccttaaagagctagaaaatagcagagtttagaaatgagtccaagcatcctgactccaaaattcacacctttgtgtgactaaagccatatctgctcataaggattttatcatctattagggaagacagagctattattatcacaataatggaaaaactgtgatattactaacatataaacattcataattaaatttacctgcagttataaaggttggtttgtctaacggctgcctgacttagctgcattctttcaggataaaagtaattcaaagaagagatcagttattttagtggcaaagaagccacctctaagccgtcacttgtttataacaaccaatttctctccgttttgactttattcacccagaagacagctgtattacagaatgacatgatgtttctcccaatcaaggtacatttagacatgttagagtacaacagtacactaaatattatcatattcatttgtatattctctgattcctatggatgactttattatttctaaaatgtttcatagtagcatttgcaaacccctacatgggaacagtctgtactatgaaaagtatttcccagtgggctgcttccctacagcagtgattcccaaagtatgggccatccttggcaaagggctctgatgactgaggtctgacccagaagtgacagtactttctttgattcttatgggcaaataacacatcacaaacttccattttcacttgtgactagatattgcttactagtaacctactaaatgagtttaaaaggttacaaattgaataatcataaaataatacattcatagaatttattgaatattctaatttagtattttttcagtatgcctgtgttttagttcattcttatactgctataaggacatactcaagactgggtaatttataaaggaaagaggtttaattgactcacagttccacaggactggggaggcctcaggaaacttacaatcacggcagaagaggaagcaaacacatccttcttcacatggcgacagcaaggaaaaccgcagagcaaagcgggagaggggaagccccttataaagccatcagctctcatgataaatcacaatcatgagaacagcatggaggtaactgctgccatgattcaattacctcccaccgggtccctcccataatacatggggattgtgggaactataattcaagatgagatttgggtgggaacacagccaaaccatatcattacgcccttagcccctcccaaatttcatgtcctcacatttcaaaagagaacttcccaacagtcccccaaagtcttaactcattccagcattaactcaaaagtccaagtccaaagtcttacctgagacaaggcaagtcccttctgcctaagaccctgtagaatcaaaagcaagttagttactgcctagataaaatgggggcacaggcattaggtaaatacaaccattccaaatgggagaaattggccaaaacaaaggggcaacaggccacatgcaagtctgaaatccagcagggcagtcaaatcttaaagctccagaatgatctcctttgactccatgtctcacatttaggtcacactgttgcaagcggtggggtcccacagccttgggcaactctgcccctgtggctttgcagggtacagcccccctcctaactgctttcatgaactggcattgagtgcctgcagcttttccaggagcacagtgcaagctgttggtagatctaccattctggggtctgtaggatggtggccctcttctcatagctctactaggcagtgccccagtggagactttgtgtggggactctgaacccacatttcccttctgcactgccctagcagaggttctcaatgagggctccacccctgcagcaaacttctgcctagacacccaggcatttccatacatcctctgaaatatgggcagaggttcccaagcctcaattcttgacttctgtgcacatgcaggctcaacaccacatgggagctaccaaggcttggggcttgcaccctctgaagccatggcccaacctataccttggccccttttagccatgactggagtggctgggatgcagggcaccaagtccctaggctgcacacagcagagggatcctggacctggcccacaaaaccattttttcctcctaagcctcccagcttgtgacatgaggggctgccattaaggtctctgacatcacctggagacattttccccattgttttggtgattaacattcggctccttgttactcatgcaaatttctgcagcaggcttgaatttctccccagaaaatgggtttttcttttctactgcattgtcaggctgtaacttttccaaatttttatggtctgcttcctcttgaacactttgctctgagaaatttttttcaccagataccctaaatcatctctctcaagttcaaagctccacagatctctagggcaggggaaaaatgccaccagtctctttgctaaagcacagcaagagtcacctttgctccagttccccacaagtttctcatcttcatcggagaccacctcagcctggacttcattgtacatatcactatcagcattttggtcaaagccattcaacaagtgtctaagaagttccaaactttcccacattttcctgtcttcttccgagtcttctaaactgttccaacctctgcctgttacccagttccaaagtcagttctgcatttttgggtatccttatagcagcaccccactctactggtaccaatttactgtattagttcattctcacactgctaataaagacatacccaggactcggtaattataaaggaaagagatttaattgactcacagttccacagggctagggaggcctcaggaaacttacaagcatggcagaaggggaagcaaatatgtctttcttcacatggtgacagccaagagtgaaggggaggggaaagccccttagaaaaccatcaaatcttatgagaactcactatcacaagaacatcatggaggtaactgcccccatgcttcaattacctcccactgggtccctcccaccgtatgtgggaattatgggaactacaactcaagatgagatttgggtgggggcacagccaaaccatatcagcctggtacctatgcagccctgacagtgcaatcatgttcatatcgcacaagcacaagtgtagatgatccagttttctgtggttttcaggaggaatgctctattgatacatcattgggattttttaaaaagtaacctatagttttcagtggctgtttattttcattataagttatcattagacttcatcactatcaattttagtttgttttaggttgcttgctttaccctctaatatgtagtgattcatatttacctataatttttcaagaatgatactgtgaatcatccatacccaacagtacttacagagtaatcgtctattggtatacctagttattttttccattgaaaagtagagataaagagatagacccaagggatctgttggcctgtcttagggaaccacagtcaaaaactgtggaaacccactacctagatacagatatatggttaaaagaagaagaaaacaatattggctttacttggttataaatataaaacagttttggtgaatgctagtccacaaaaaattagttcacttgtacttcctcacttatttatataatttgttctttttgctttcatatttaggaaggtttggtttttttattaaaaaaaaaatcaactatcggtactcctcctatccccccatattctcattcaccgcaaactggtgtacttataatggaactggccagactagaggatttaataatagaattactctttgaagatttaaagattcacaaatacaaactttcagtcccagataagatggagtacacacattttattttatttttcctgctactcacaaccaaaaattacctggagaaaatacattaactcatctaccagaagactctgaaaggtgcaaaaaaataaggcagacaggctagagacctccagacccaaggaagtgctgtgagttcccaggcttttttacttgcctcctgtattacctggcctgggtgttataaaagcctgcaacctgaaaacatcaataggcaccgacaaaatacagtctttagccaacggactctctttagccaacatgacagaaatattttaacaacacctgcctcttctcaaggcagaaaccgtgaaaaaagtcatgcttctcttccttcaccacaacaggcataaagaggttcaattcactaagaagacatgacaatcttaaacatgtatgcaccaaataacagagattcaaacagtagaagcaaaatctcccagaactggaaggacagattgaaagatttacaattaaggttggggtcttcaacatccatctctcaataattcatagacccactaaacaaaacaccagcaagggtacagaagtactgaatgactgtccaccagcagtttctaactgacacccaacaacagcagaatacacattattttcaaatgtgcatgagatactcatcagaatagaagttatcttcagtcataaaacaaaccttagctttaaaagaacttgaaataatacaaaatatgttctctgattataatgaaatcaaactagacatcagtaacaaaaagataacaagtaaatctccagccacttggaaattaaagaacatacttctaaataatccataggttaaaaggaagtataaaggaaaatgaagctgagtgaaaataaaaagcatatgcttagaggaaatttatagccctaaatgcttacatgagaaaagaagaaagatggcaataatctcagcccctacctcaagaaattagaaaaagaacaaaacaaaaagcagaaggaagatttaataaagataatggaattcaatgaagttgaaaacagaaacaataggtaaaatcaaaccaaaagctatgggattttttaatttaaaaaattgacgaacatctagcaagactgataaagagaaaaaggagagaagactcaaatgaccaatatcaagaataaaataggcgatatcactacaaccctcatagacattaaaagaatactaaagaaatacaactctgtgcctgtaagtttatcagttcagatgaaatggaccaattcctcaaaacatacaaactgccaaaactcacccaaaatgaaatatatctgaatagttacataactattaaagaaatttaattaactattaaaatttccaaaatatcaatacagaaatactttaaaacaaaagaagcaaaaccacagtactaatatttttgtattgattgagtgtgggaataaggaattttgctttcattgttatgttctgcgctgcttttaaagtgttggaagcctataagagatttgatgtacaagacttgtaacttaatggaattcctaagatactgattaaattcatcagttttattaattttgaaaatattgtttaaatgtttagaaatttttatttcctcaatttttaagttttaaaatttgaaaactaaacaaacaaaaagattcacaaatatgccctcactcttgagaaagatttttgctccctgtataaaacagattactgataaactgaagccagccctttcagcttcacatttgaacaaatgtgggtctcagtctgctacttcctgggtagaaaatgactgccaggaagcaaaacacaaaatttggctcaattagtgatgcaccatgtaaaacatgatgcagaagaattgaattataaatttattaaatttaagtcttatttttaattcctttttgcctttagggaaaaaaaatacacaaattctaataacaggcccttggcttggttggtaagttcagtaattaaaaactatttggggacatacctgcctttagttgctttgatcagagagcgtaaagaagccccattcccttttatgttgtagacgtttgtctcctagctttatagcctcagaaaatgtcctcaaattttgtaggcaattggctttttttttgctcccataatcaccctactcgtattaccttgccaccataactcatttaatcagacatctcaagtttaataaaactgtaggtagaattatcttacccctagaattctttaaagcctattctgattgaaggtcataacctgtaccaaattattttcttcacttaactcccacaatatattaatattactcccttgatggtttcagcactctcagcctccacaaaactatgggtataatgatttgctgtatgtactaaaattatccaaagtttcctcttaataaatgatattaaggtacaataatttattactgttagattctagttttttaaagataaattttctaagaactatgttaaattgtttgcagccattatggatttttcactagttttgactctgacagcaattggcaatggaccaaagtgcataagctcaacctagagtctcagttctaaatgatactgctaaatctgtctcttaacatttctacaaataccagggtaatttaggaacaggatcctaatagacttcaatccaaaacaacttggaatgctgagaaatagatcaatgtttcaaacccatgttctttatatgtgactgattttaggtaaattagtgtaaactttcctgccatagtaaacaggagaataagttgtcttcccatggtttcttttattttcataaatctagagtggtcccaagacataatggttcttgtgtctgatagtctccagataagagttcagcattaagaagagaattgccttttttaaaattcagctataggtcagctatatatttaaatatatatagctatataggtcagctatatacttaaatcagctataaaaagctaggcacatttctgaacctcagtttctcataggtaaaaagaggataagactacttacctgttttttttttttttttcagaattaaatcacacgttgtatataaaattatttccactgtgctgagcacatactagctattcttaactccatatagaaagaaaattagttactctgcatgtaagggaatttatcttctgatgagcaaatcaggaagccttctaggactaaaacagaatgcacttcttttgggcattaatgagtatatccattgaagtacaaccagggaactagaatctctaagtggcatggaataaaggactagatcttattcagttgaggagctggcaaagatgcctcagcagagccagtggttgggaagaaaatctagacatgaagtgaggaagaacaagacaaactagaacccatgagcacaaaccagagcatttcctccaacttcaacaagaagctggtacccttctccatggagattcacagattcatggtcccatactcaggtgctgaaggaggagatccgattggagctgaaggagttgtagacctggctgctgactcacaccagtaaggcaagccaacagaaaagtaaaacaatgtgtatcagctgcagcagtgactgacaccctgccctgaccttcggagcaaaagagctgctgctttacttgtattctccaaaactgacacaaatttacgtagtggccaaccctaaactagaaccatatagacaaaagaattctaaaacacatagttccttccagcttagctaaattgatgcaataggaaactaccaaactgaggtttccttctctgtggccattatcagtgtttactgtgtaaaacctgctttgaaaattctctactgggagtatgtatgaggttcagtggtaaaataaaaatcataaattatcataaatctagagtggattcaagagtgtagcctacctctatgagagtaccatctccacaacctacttctttaatttaccaaagcatatactgagaaatacatcttagccaaatgttgaatcttcttcacttagttgcattttaaaataatgtcctcaatttttatcatatggttattacaagaaacagccatatgaaatacacttcttcatttgctataaaatgttttttgatattgtattttctatttctttgtaccttccatcatatatatttttataattgggtaaaagctttggctctgtgtggtgacagtatatgtaaagatctgattcagtgtctggcactatgatagtgcacaaatagtatacccttcctccaacagtactaccaaaatgtcctcaccagtgggctgagaacaagcaaaatgtaatctaggtgcatttgaggtaaccagttctgaagaagtggcagcaaatatcaagccctccagaaatttaattttttatactgagattgcgtaagttgcctcctttcttttactcagttttctcatttacaagacaagtgtagcactgcagagaggactatgaaaaatgccatctaaattgacagcataatgatgatttgattcctgctgcaagcgcagaagttaaaatatctccccatcaagttcttttttcccttctgttagataaaaccaattttcctttttttagtcttaaaatcatgttttactatatagttcagtattaaaaggaacagtctgaattatatatctcaattattttataaaataaattgcatatagtgacttttgatactttttaaaattctatttttatacagtactctttgaaaaatatttctgttatgaaaaaagtctctaaatcaagaaaactctattaaaactaccagatgtagaaacatctgaagtagttgtgttggagagcttgtctattatataagagcaaaaatatcagaataagagtttaacagaaacgtagtattaatatgataaagatatttagataaaagctagcattcttggaacaaattatactgacacagactttcataatgagaaatatgtacattatatcagagaaatcaacctaaaaataaagttaaagtaatcagaaaaaaactttgatttcagattcttttacaaataaaaccattaagtccacaaccagaaaagtttttcagtaaatatgattcagtcacatcattgctgacagaatcatcaatcataccataattgtgacttcatttgagattcttgggtttcatgcatctctgttagaggtgattctttctatattatttattcctctatttcttttacacatagtttatttccttgtcattcattagcctgcaggtagcaaatctggtcctctccattttttctggttataaacatttctttgtcacaaaagacaggcaaatctactcttatttctctgacacctaaatttcaacggtttctgtcaaacagaagtgtcaggagtaggagctgccctagttctgcttttcacctgttagaacttgctgcctctgtctcaagtgcaaatctatgttaattgtacacatcaatcaggcaccccaaaatagctgtatctaatatggctggtgataagttatttccatacatggtggaattcaaacataaactaagtgcttttcaatgaataatctagcattcagtgttaagactgacactgattacaggtatacatataatatttcctaaaacatcaataattaggtctccattggtgatcattaactggttttccattcatttttaaattatgatcctggaaagttattgttctatgagacatactaagaacatgtggtccaaatccctgatttcgcagttgaggaaattgaggtcaagagtagtccagtagcttgatcaaagtcatagagctggaatatagactgaaatatgaactgaaagtcaggtctcctgattcctaccatggtgttgcttcattggtaatgtgtgttcctttcttgctgagaaatgagcattctaagtgtatcactccaactgatttgttgaaaatagactgaaggggccaagggtaagtgtggaagcggggagacaagataggatctggtcaattcaagtgagagatgagagtgacttaaccctgggtgttaaagtggaagtggtgaaaaggggttggactctggatatgttttgaaggtaactggacaggatgcgctgacagattgcatatgagaagccatgaatcatagcccatacctcagtgtcccacacataggtggtgagtaactattcaattcatgccttcaacagataattgtatgtcgcatcctgtgctaggagctgagtatagagtggtgacctaaacaaatggtttctgccttcatagaactaatatagtaggtaaaaaccattccttcagaaagtgagccaagtaattccaaagcattgcgtagtattgaggagtgttttgggtggaaaatggcataacacaatgaatcagctcaagagagtaaagaattagtcaaaaggcaggctggatccatgattttctcatcagtattgacacagggttttctaattgaactgagttctgttaataggcttgtactgaaatgtaattgcagtcccatctctgtctacttaggctgggccttataatattatcgtaccttaatttctgtctcaattgcaaaattaagatgttaccatgagccttcctttcatgcagatgttattataagcggttgcccagaaactcctgtaaatcttcttttataacctacagagcaatataacttgctaattaaaataaaattgagaaagcatgaaaattagagattgatgagatgttattggtttgaattatctccattgatataaaagtgtttttctcactgataatctttctgttttggagaatcctttctcttcacatagcaatgtacttgcatcacctgtcatgagatgttttcataaatggatgtcttagtgccagaagcactttttctctctctttaattgttactatgactacataatacttacttgggaggcagtaatgcatgtagtaggagtataggttttggggttgacagacctggctttgaattttgactctacccctacctgtgtgatcctgagcaacttatttatgcattctgggtctcagtttcctctttcttaaaatggggttaatgataaccactttacatatgtattataaggattaaaatggatcaattacatcacttataaacacttgtaagtgcttaatattgtgcctgacacataataagccctcagtaaatgattattattttgagctaaggatggcagttcttatttcccaagggtattgattcatgttagccttcctgaatattttccaagtaatcacttcccttcttcctacattaccactgtgtaggaacaggaggactcaccttatgggatcctgcatgagagtcaatcacatccttccttcagaatctgatacatatgacattctttttgatggaacattaactctgcccaacctaagtagttgtagtttgactgaccttctctagattcttaccaattactgtctttttgttcttatttgactgctaatttactggtttataaagcatgcttatttttgagtaagtgtggagccattttcagttatacatgtaccccgatcctaaaataaaagtttaaaaaaaatcaggtcgacctgactgacagaatccagagctacctcatcccactctaatgaaagacctacggtgtgtgcagtgccacatccttcaccctgattgactccaagtttttctttcatgcaccagaatgagcaaggccaccaacaacagcagacttaagttctatgctgttatttcttataaatggaaattttttgacttaatatttggttctattgtcatcctatcccatttccatatatttacttttttcttcctacatacaataattagaaagttaagagaaaacattttttgtaaagtatttaaaatctcaaagagttttacttgtttatttaaaaaaaaagtgtggaagcagctatcatctaaagtgtttcaaattgttaagcaccttcttttcttatgtataagaaagaagctattggtttgactagtcactgaagaaatcttggaactttgcagaaaattacagtaagaggaaattgctattactgcaacaagagagtactttgattgcaaatttttccttaagtgtgtcaatttgcaacttgagaagaatttaatagtagctgagctttcaaaatgtaacacagaaactgatttttttcacaattaaaataagtgcttctgataatttgaggataagaatgacccaaattaccctgcccccacacttctccatccaaaagagtggggaatgaagtttgaacagaacatctgtggacagaatgaaagacaaatggtcttttcaggcaaatgtctgaaaaagggatctttcatagccaaacagaatactgttgcatgcatcgccatggttaagaagatcaaaaatactttcataatagccttttattttagcacattctatttttatggaaagaattatgatttcaacacattcattcataactcatataattattagcataaatatcttttgacacagatttaatgtacttttgccaggcatattgtgaatttaaatttaaactgttaaatgcactaagacaatctcagtgcaagtagtgctgaaggagattggataaaaggaaattcttcttatctaccaaaaggaatggcctattaaagaacagaattttcaataatgtattatacatggattcatagacttcttcaagttacaacaatcagctaattaagattacaacctgtattctttgctgatggtttgttcaacatccattcacataaccagtatttattgagtgcctactgtgctaagtcttactctaggcagaggacaaagcaatacataaaacaggcagaattgcccttttttaatggagtttatatttggaggaagtccaggtgataaacaagaaatataaatacttaagataatgctaaatgctcagaggggaaacaaagctgggaaaaagaacagaaagtattgagggcaattgggataacaattttggacagggaagcttgggtagaatttactaaaaagaaagcctttgtgtaatgacttgaaggagttaagggagtgagccacaacaacatctgggcaaaaaacatttcagacagaagaaacagcaagggtgaaggtcttgggatgggactgtacttggcataatctaagaacagcaaaggtagctggaacaaaattagcaaggggagagcagtaggcaaaggtaacaggggaccagatcatgtagggccttcaagtcattgaaaggatataggcatttattcagagggacatgagaaaccattgatgagttttgcatataggaatggcatgatttaaatcatattttaaccagatcactctggctcttgtgctaaaaattagagggggctggtcttagtggctcacacctgtaatcccagcactatgggaggataaggcaagcagatcacttgagcccaggagttcgagaccagcctggggcaacatggtaaaaccccatctctactaaaaatacaaaaattagctgggcatggtgctgtgtacctgtagtcccagctactcagaaggccaaggtgggaggatcacttgagcccaggaggcagaggttgcagtgagccaagatcatgccactgcactccagcctgggtgacacaagaccttgtctcaagataaatatatataaatatatatatttatatattatataatatatgtataaattcataatatatatagtataaatatattagagagggtaagagcagaagcagggagaactgtcagggggtatttcagtaatccaggtgagagattgtggtggcttagaccagggtggtaataatagagctggtgagaaaaagtcatattataaatacattcattgtgaaaacaaagctggtaaaacttgctgatggattggctatggggtataagagaaggaaaagagttaaagttgactccaaggttttgtacctgagccactagggaggaaaaaaatgtaattactatttaataagatatagaagagtaggaaagaagcagatttggctgatgagtgatagatatcatgagctcagttttgtacatattaaatccactcagttaggcaggctttagctcagtgaagaagtcctggctagtggtatgaattcttaagttgctaaaggtcagaatttatggaacattcttagaaagttcgaagaactttcacccagatgctcactataataaacagaaagtgctagtgaaggcattagaaagattttaataaatgatgtttttggaaaaaatgaagatgggaatttttagagaattggacttcaaaaatgctaacaagagaaatccatttttggtgatcaataagcgttacaagcttgtgctttaaattcacatacatacacaccctcacactcaccctaccctaaacacatagcaataaaatgaaataaaagatatggtcatggtcaaaaatgaaatctaatctccaggcaccagaaggaacaaaaatgctcagtgataattgggacctaaagccacatatcttaggcaccgagtccagaaaaagatagagatgcctgagagtcttctctaatgagtatcagagaaccaatggacctcagctatgtcggaaatctaaaaattgactcacgaggtgtaaccaactgggaaggcaagcagagcttcctcattcatgagtaaggaggttaaagatgcagttactaagaaataaataaagatacagctacttgtataaaactgaattcctaggtgtctacaagtaacaaaaacagatactcagaaccatgggccatgcctctcccacttggatttcatggatggaactgcaacccattgccaccactaaaacgcctggttagtgtcccaaggaatggaggcagagacagcaagacgcttagttaagagggatgagtgcaaaaagaaacatccctccaggaagaaccttccacccaagctaaaattccaaagcgtctagagaaaattaatacttttttaaaaaaggcaataaactaaacaatgaggtgattttcttcactaaatgcaaattacaagaaggtcacaaaagcccttaaaatacatttttaagtaaaaacaggaaggttaaacagtggatattcaaaagagccactatcaactagatacactggaaatgtaaaatatatgaaataaacactctatcgataagataaactttagattagattagatacaatcagtgaaagaattaggaaattggaagacagtaaaatgaattcccctaaaaggcatcgcagaaatatgaaaggatacagaacatgaaggacacatggaagataaattgagaggtaccaacatatgtctagagttttaaaaaggggctagtaaagaagaccatttgaagagattttcagaattaaataacactttcaatacaacacaaaaattgccaaatagagtgaattagataaattgtaacctagacacataatagtgaaactgcagaatattagggataaagagaaaaatattttagaagctacagagaaactaaagacagattaaaacaagcaaatgacagtgtaactacagatggcttaagagaagaaaaatagatgcaaaaagaaaataaagtaatacattcaaattgctgaggcccaactcagaattctatacccagccaaactattattcaagaggaaaggattttcaaacattaaaactaggagagtttgccactcacagactgctgtgaaagaacttctaaagaatatacttacttgagcataaacttggaagaagggtaatctgaagctaatatgaaatatacatgaatgagatatattatgaatttttacctcatgagaaatacacttaccacgaatgcaaagattctaggcctctttcatttttcagttagttgttgtagcaccttatatgatcagctgtgttatgaattacggtcatatgtctgtttttaatgtcttgctcttattaaatttgcataatcttaaaactggaaaaaatgtaccaattaaatttctgtcactgacaatgaataattccatcagttctgctagaaaagatgatacaggatgataaatttgcacctcaggggtgcttactaacactgtagctgatgacataaggaaaaccctttctggagattatttatgtccattatttatgaataatgaacagtttctaatataagtttgtaagggatctttttgaatgtgaggctcttttggatgtccccaagaccacctacatgttcagtgatttgctagaagaactcataggactcaacatatagttgaactcacagctaggatttattaacagtgaaacagcaggaacctacagacagatcagtaaggaaaaaagacacctgtggaatctagaaaaatctatctgcaggcttcctgtgctctctccctcccatgataggtcacacagagcatactctcctcccagcagctaaaattcaatcacatgtgtgcagtgtttctgtccagggaagcccgttagagattcagtacccaaggatattgaattgggcatgtagacatcctctgcctagcaactaccaaaattccagacttccagaaggcaagtgaataatcagtgccccatgtgggcaaaataatcttatcatttagggaagcttcttatcagtatagggaactgtttaccagccaagttcctagatgccaaccgagggcaaatactgcaagtaggcctttctaagatggcaacctcaggcctgctacagtaactcttttctgcacagagacctaactgtatagttttaatagattttcccattacttccaaaagcatataatacaattaactttttcattttagaaaatgtcaagtcaattggaaaaataataaaatctctcttaagagaactttattttaatatttataatatctttaaaagacatctaaggctttgcttctttgaatgatggataaatctgtatttaatgtcttggagttttcaggtttccagtgcactgattatactctgcagtcatgatctttatggaaatatatttataggaaaagaaaagataatcttgttaaaaagaaaacctggagagtgtaaaatatgtttcatgtagatttttagagtagacattcaggttctacagaatagcatgcaaaaagcatagaaggtacattatataacccagttctttcaagctgtctgtaatctatgtagctttctaaaaacaaaccacctccatctttgtcatttttcaaaataatgagctgtaaaactataatgattacttgcagaaatacaaagggaaaaaaaaccccaatcagtaattttaccatgaaacaatgtagggaaaataactatctgtaaatgagctatacttaagcacactagcctgagttattatttgagttattattttgaagcaaagtgcattcaagaaaatcaacacagcataatgggttttatcttttatgctttctctcaaaatttgtgaatttctataaccatgcatgctgcaaagtttgatatgtgtgtgtgtatgtgtgtacacacacacacatataccacatacatacatatttataatgctttaacacttaggtgattatttctggaaagctttgtatgtcagcaaattatctgacccttatctttaggactgatacacatccgtagtactatgttcattagacttatataaatcatatacagaacaaaaattattatataagtagaatattatttaatgagcaatgatactaaataataaagtatcacaaaacatgaatttattgtgaaaaaagaccagcaaattttatataagcaaaatccagttgccccttatagatatatctttgtaaagaaaaagaagaatctgtaacctgattttcattttgaaggaatatctgtgaattaaaagcacacatgctatctctgttcccttttagctggctgatcatgtgaatgtaatgaatcttattataccagtgaacaatatggcttagtagactaactggagccagtgatgtgtagtcattaattgaaagttagaccaatcaatatagttgtgggtttttctctagacatatcaagctcttcaggtacttagcatggagtgaacagacaggtaggtttaactgggatggatgtttagcttggcaagtatgatgcagcgagcatggtcaagggaacgattataatggtatcccatggaaactaagaggaaagaaagaaatacaggcacaagagggtagttaggtcaatgaactggatgcctcaatgaagtttttttttaagtgatgacatgaaggtattagagactatgtaaaccatatgaattagatacagtggctggtgtgtgctttagatatcaaacatatgattatgggggtaggtagctgaggagtggggaagtaaatgttattagaactgaggaaccagggtgctgacatcatctacatgaagattagtcaccaataatagtgacagaagtaggcatgagaaaaaaatattgttccaagtgctgaaatatgtagggactaaggaagtaggagaacagtaggtgatggtggcttatgtaatagaatgaacttcatgtgaacaaaggatagtcatattttcctgcttacttcattagattttgtgagactcaaatgagatactgtctggcaaaccacaatatacccgtgaaaaggtacaaagtagtgtgtatgtgtaaaagcctttagttttaccaaatgctttgtgccctgatttctctgcctacaaaatacgggtaaatataatatcctttcctgcttcacaggagattagaaagttaagtgacatgatgtatatgaatttgttttgaggctttgtggggaaaaagttcttcccctaacagtgtttagagtcatcatttagctcttgagagttctgtgtagcgtgctggtgctctggatcacaccctgagtatcagataacattctttttatctttgatttcagacatttcagcagtcctcactgcagcacaaatcaaagaagaaaaacaaaggtaagaaaaggaaatgaaacctttacctgcttattttgctctttgataatccccaacacacttcatccatgccctctttcttgcctgagcccagtgtggtttagaagagcacaacccccttgtgcgaaagctgccagcttcttcttcagtgcaattataatacaaggtaccttttacaacaaatgatctcaataagttttgagagtggtgttacatatttctgattaagatgtgtgtcacttatgtgagggaaaatattaaagatttttatatttttctagtctaatacaatataaaaatttttaagattttcaagaactcatacttctttttggtatctatagattaatcctctactttcatacctttgacaaaattgaaagagcatttccaccctttaggtcctatagcaggcaagagcaaaagacgaatttcttgcaaagatcttggccgtggtgactgtgagggctggctttggaaaaagaaagatgcgaagagttacttttcacagaaatggaaaaaatattggtttgtcctaaaggatgcatccctttattggtatattaatgaggaggtaagataaagcaccttttgttttctcatccattctctatctttaatcaaaagaatcattttgagacttatattttaaaatcgtataatcaccttaaggccaattcagtagacttctgctaggtatttttcaatccaccctcttaaaatgattgcatgttggggttctagaaagatagctgtctcaattatgctaatgtagcaacatatctgaaacacagataaagtgtagtaaaattctgtatatctaaataaaaatgcgaagctaatccaagcagtagcttaactaaaaggattatatgtggaaatttgacattaatttttaaatgtcttgcttttgttcaaaattttacacttttttctggttttttttttctttttagaagtggggaaggggaagccctttactaatttaagtaaactaataccacctgaatttatttccatttttctttaaaaatgatctagtagactagttttgaaaatctgcaagtattcatttcacttggcccagtgggggggtatatatataatacatttaaattattcttatgattttctggggtgttttaatataacagatttatatccagaggagtcatatcaaaacttattacgtatcttgacagatatgccaaaaacatttgttgatattccctttattctgcatttgcttttattcctttgctatagccatctactagttcactttattagttttttaaaacaatgatttctgctatttccttattttataaaaaatgtacatggcttaatgtagtgtgctgggtgaatagtccaatactattatgttaagacattcatcaatttgcatttgaatattgttgaaatataatttaacaacattattatgcctacgattacaaaacataatatctagataattttatgttccctagacaggttataatgtagtgttatgttgtgtttaagagtagactcagaaatcataccacctgagttactgtgccatagtttcttcatctgcaaaatgagagtaataataatgcttatcactggactatcatatggatgaaatgaatcaatgcctggcacatactgagtgttcaataaacatgtggtaggctgggcccagtggttcacacctgtaatgacagcactttgggaggttgaggcaggaggatcacttgagctcaggagcttgaaaccagcctgggtaacatagtgagaccctgtctctacaaaaaattaaaaaattagccaagcgtggtggtgcacgtctgtagtcccagctacttgggaggctgaggcaggaggattgcttgagccagggaggttgaggctgcagtgagccatgattgcaccactgcactcagagcaagaccctgtctgaaaaaaatgtgtgctattagtaacatttttcaaagggacctctcattttatttgtaaaatcttgaattaatatttttctatttaatgtaaatgtctatatcacctatataaaaatatttggttgttttctgtacttttgacatttttgtggcaaatcacacaattacctaaaataccctctgcttcgctaagtgtgtcttattttaaatgtaggaaacaagccataattttacctacagtttcatttaatagatatatattaaatactttttatatgccaatcaaatattatcaagatatagtatctccatgtttctctttattgtaaggtcacttgcaggtttgtctgccacatactagattatatcctgtctttcaaagtttaagtgatgaaaaactgtggcccctttttgttgaactaagtttcattcagcaagttattgttactgttagccttgtgagagatgagtgaagaattctacagtatacattgcaagaaatacctttaatatgataatatttttaggagaaatgtaaaaatccctcatcacatcattatggggagataataactacctcaaaatattttaaattgttcaaaattttaaatatttacattatgaatgtcaagggtaaagtaacatagaaattaaagttgggaaaaggatttaaaaatactgtcttgtccttactccaagattggaagaaaaaatattcaaatactgaaaaagtttaatactactctttttcataacacatattcagtcactatcagtagcatcagatttttgttttgcgtggaagcttagcagtgaaagcagtcatacaaatatacaatctaaaagaatcgagaactctttttttcctctgtgatagtggatgggagtataatctcacttgaacttgatatataaggagctatggatatagcacagatcaaatgaaagttagagatagtaaaactcagaggagcttgatcatgagcagaacaagggatacaatgattaaagcatttagcaaaagatagttttagcttagttgggataactcgtatctaacataatattttggataattcttctgtcttgtttttccatccagcattagagagagcaggattttatggattttattccattttccaggtgaaaaatgacctttatatatatatagcacataccccaagccagatatttgaaagtcagattgacctatttcatttgtaaactcttgaatgcacagaataattgttataagacgctgatgagcttgcagagaagacaagaatacttatatactgttggtgagagtataaattagttcagccattgtggaaagcagtgtggcagtacctcaaagagctaaaagcagaactaccattccacccagcagtcccattacagggtatatacccagaggaatgtaaatctttctaccataaagacacatgcacgtgaatgttcattgcagcactattcgtgatagcaaagacatgaatcgacctaaatgcatatcactgacagattggataaagaaaatgtggtacatatacaccatggaatactacgcagccataaaaagaatgagattatgtcttttgcaggaacgtggatggagctggaggctattatcctttgcaaataaatgcaggaacagaaaaccaaataccacgtgttctcactcatatgtgagaactgaataatgagaactcatgcacacaaagaagggaacagacactggggcctacttgagtagggtggatgggaggagggagaggagcagaaagaataactattgggtaccaggattagtgcctgggtgatgaaataatctgtacaaaaaacccctgtgacacgcatttacctgtataacaaaccttcacgtgtacccctgaacctaaaataaaagttaaaaataattaaataaaagatcattgttgcataattagagaaaatcaaatttgataagagatttgttggaggaaaattgaatcagtgaacatccctatattttacatctgaacattaagaaaatagaaaattgtgaattacaaaagtggactacatttattttatatgttatagaagtgtatgtatgttctgaccagaaaattagttataaaacacattccactttgagaattaaagaattttccattctcattttaatatgaaaaagactttttaaaagttctatactttaatttgtagtattctaagtgttcaaaatatatcttcaatttatggagtacagcaggtaagcattgaattcttatctctaaaatgtcaaatttaaggaattaaaggaacggatttattagtacagatatctaagccatagttacagagtatcattaccttcacacctttgtatataataaactaaccaagagtcttggctcttcaggatgaaaaagcagaaggattcattagcctgcctgaatttaaaattgatagagccagtgaatgccgcaaaaaatagtaagttgattttatttgggaagagggaacgatagtttttttttttaatttccagcttttaaattataggttgctcatttaatgctttcacattgaggtaataagaaagcagttttgtgggcagaaaattgaactttttactgatttctgtcaccatgatagaagcattatatatgtgaactcgggttagatgttgaggtaattttgcccgtcagaattatttggttcaaacttatttcccaatttgtaataaatgtactttgtttccttttgcagtgcattcaaagcctgtcatcctaaaatcaaaagcttttattttgctgctgaacatcttgatgatatgaacaggtaaagtatttcagagtatgtagaaggtcagtgaggcctagaattctaaattttctacagtaattcttagagaataatgtcactgaagtttctaggtcaatcagtttaaaataaaatagacccagaatagctccatgcagccatatctaattttaaagaacatcatttaaaaagtcaaaataaactcgttaaatatttttgtcaagtttaccaagaccatatacagacccaaaaaaatctaccaccaaaaaaaggggattttttaagttcatttcaataatatgtcttaaaattgactcccagatgggggaaaaagagatgtctaccaaaaaatcggactttttgaagtactgagtatttttgacagaatattcatctcaataattcaggcctaagaaaaattagtatttctttctgtcacttttcatctttcacctgacaggaccacaaccaacaaatcagatagctcagtggttacttggtggctcagggaaaacttatatgtacattttttttcttttctcatcacctaccacattctgcttcatgttaatactttggcttttatgaattttgtgctttcttcctttctctttcctttcccctcttccttttctagaattatagaaattgagcttaagattcaaaattttcctcctttctataacttactagccagtacatattacaaatataacttgcctacagttagggagaggcagcatagcatcatggtcaggagcatggactttgcaaccagactctctaaatcccagctctaccacttaatagctgtacagccttggacaaagaacatgacctcttcattccaatatagtaatgtccaatctatacaagaggtggatggggctaataaccagcccaatctcagctctacactgattagctgtgagaccttgggcaagaaactgaacctctctatgctgaggtattagccctttaataaagtgaaaataagactgacccctatcagtaagacttttataaggagtaaataagcatacataaaggacttagaacagtgcctgctaaattataagtactatataaatgtttactattaatatatattccttttatatacgttgggttcttactccatctacctttctctaaaacaattgtacccaggcatttttaagcacaaaactgtatagctgcataaatttgcttgaacatactaaatgaacacttaatgtccttttataaataatcttgttctttgacatttgggaatacaaacatgttttttttttttcaaagcaaggatatgaatacaagtaaatggcaaagaaagatggtgttgagagcacttgattaaaacttttattactaataaaggaattgagcctttcgtatagtttccataatcttctcttaattcatataacttatcattcttgaaatttcacaccaagctataaaatttaaatagttttttctccttgttctcaaaatgaaaatatttattcacattcacatggagaaggagaggtgtgatactccattttatgttttaattattttataattccactgttctagtacttactatccattttaccatatgttaagctcaatacccttgggataaatacgaagaattttcatcatgaccacactgaaattaagtggcatacatgagcatatcgtatcttacaagatggatgcactagaatccagccaactccaagaattaatacaatgtaatcattcacaatacatgctaattgggatctttttaagcttagaagttgcctctttcaaagtgcattttatgaactataaaatccttcttggccctcattacccaccccaagttagcagtagcttcaaaaggatgctgatgtcactgctctttcctaatattttgtggctgtatctggttcgggatatcgcagaaactaaaccaaatttgtgtggttcattttgttggttttctaagcaataggtgaaagaaaaaaagtgaaacattaaaaaggccgtctccacattatacatttaaaagtgctgttttatgtaaagcctgccatggcccactacaactttaagaatttaattgtcccaaaatactgaattttattttaatttaattaaaatggatttttattgttttgctttgaattttgctttctaaaaaataaccctattcctaatgtctactttcaatgggaagatttttaattacttgttaatagaagggggaaagagtcagtgctacaaatattcacagaggattaatgatggggaggaacacccacctacagctttgtcaagtcacctgactgttacataacagcaagatgatctgggtgttggtttgttctatatgtaatcttttaaaagcatgtatctaagccttcaagagattatatatttataaaaattattataattatataatgtatgtgattatttcataattttttaatatcatacctacttcttatgaaaatacaccatgtttcagagaaatatatttttctgttcctcatttaaaaaaaacaaatgtaatgctggtggtgacaggacctagtaattggtgttaaaaagttatccttacatttaattttcttctgtaaaatcatacacatatatatatatatatatacacacacacacacacaacaaatatttatatatgtgtatacatacacatacacatagaatattaaaatatcaccttctattttgagaagcagtaagtttgattgtgaggtcatttgcaaaaacacttttaggcaccccactactgttcatctgtttcatcagaaataagcactgaaacattaaaaactgatttttttcttgtctgtgtaaaatctgtggggataaaataaaacatcatagtactcaggtattctgaagacttatttactgaatttgtttggcctatatattccttaccatgtcagtacacatgttcttgtaattgtgatgactcaccaattcctatttggtaattattatttatacatttctctcatggttctttctcttatttccctccaaacacattattctttgtcagttgtgaatatctcctttgaatgtttgctataggttcaatatcaccttacctgtattttcctattttaaagcattggtgatatggtaaggtactgactgaatttagacctgctattaaatatcttcctcataaatatattgaatagattctaaattcaatattgtatctctgaccatcttacctaaaatagccttccctcatccgcagcatctttggcattctaattttctaacttgcttgcttgtctgtttttaaatagcatttgctactatttcacatatgtttatttgcatccctgtttagtgtttatctccgtcactaagatatggaaatcatgaaggcaggcactttgttttatctctgtatcccaggtacctggcacatatagctgttaataaatgttgcttgaatcagttgatgcatatgtgtctgctttcataataacctaaaatattaaattataactgtaacaagtaaatcagtaagtatcttctagtttaatcctaaaggataagtttatccaagatagcaccaacaattgtgttgtatttagccccttgtggctctacacagtggcctgagtatatccacacactttctaaacaatttttcttcaattaacaaaatttttcttcttaagaatagtttaaactttcaattgtcttgtgaaacttagtaaatctagagttaattgaaggcagaaattacgtcttatttatttccgtatccctaaaacatagcttattgttcagcacatagcagacacttaataaatgctgttgaagtgaaaaattgagcaagcccctttttagtttcctaatttatttcttaaggacctctttgttctttacatttctgataagatgaaatttcagtgtttttttttgttttggtgtgtgtgtgtgtgtgtgtgtgtgtgtgtgtgtgtgtgtgtgtgagatggagtctcgctctgtcacccaggctggagtgcagtggcacgatgtcagctcactgcaacttccgcctcccaatttcaagcaattctcgtgcctcagcctcccgagtagctgggattacaggtgcctgccaccacacccggctaattttttgtatttagtagagactgggtttcaccgtgttggtgaggctggtttcgaactcctgaaatcaggtgatccgcccacatcggcctcccaaagtgctgggattataggcgtgagccaccatgcctagccttcagtgatattttttaaagtagtaaagataaggcactggattaaaattcaatgataaatttttctttagtggtattatcatcattttcaccaaaaagcaccaggccagtctttcccaagagtggtaagatatgccttgtggtacaaatttaacccctttttcactgcaaatcaacttagactaaattttaactttgaacttttactaatgattagagtcatttttaaaacattgtcatgaagtttacttcttgatttatagcttataattttctggatgtgtgtgtgtgtgtctatatatataccatgctactgaattcatttgataatctttattttattccagttctactccagtcttttcttcacttcccaaatgtacctgaggtgataattacattgtaggttttgctaaaataaagttaggttttaattgacctattcttacaattaaagcttaaatttccatagatgcgattttgtctattagagacaggaatttcctcacttttcaagattcaagatattctaagtatctgatgcacagttaacaccatttggcataaatgatgaaatatgagtcacttcaaagaatgtgatctttcacttgacagggaagataaatgtcttaggagaaaaagttctcaaacacaattttttcttaaaaatatatctagattagattattccacaacttaatgacattaaccatactagtgattctggacatattcaagctagcttgaaatgtaggtttttcttcaatttctgatttgggaaagtatatggattatggctcaggattgaccaaagggaaatttgcatgttgtttaaagacttgtgattagataatctgatagtgtaaatagttgaaataatgaacataaggagagccctggtgggacaaaagaaagacagtaaaactgtgctttgctttaggcagtccctacattggcaatagcagcactacagaaagagcaaagaactgagatttatttttaacttacaattgctcatgaaaatacatgttcaagatctaaacagatgttaaaattgtataagttcattgtgtctttggaaaaccccatacccttgtatttagagacaagtgtccgaagtactcccaagatgtgtttcctgttagattgttaaataagcttaatcaaaactatgatttcataataaaactattattttgacaggcaaggtccataacttttttccctcatcagaataaattgaacctgatactgtttaaatatctctaaaggagcatttgctctgaagaaacagaacagcaggaatatttggagtacttctacatttggaacaatagaattaatatggctttggtcatctccaaaccctttatgttacagatattaacagctttgcccaagacttttctattgaagtagcatctttggtatgggagcaatttgtactatagcaaattgtatctcattaaagattctatgtatcaatagtagcaaagaacacatcttatatgtaggattattccgtatattcttagacattttaaaataaatgtttctaggaagtaaaatataagaaattaggttacaatgttattgattttaatatttgttttctcaggtggcttaacagaattaatatgctgactgcaggatatgcagaaagagagaggattaagcaggaacaaggtaaaggaatacttttttaaaataattatgttatactttttttcctgcagttatcctatacagaaattcattgctatcacttgagagaaaatacatgtcaatttttggttatttctcttctaggcacttaagtgaggtttaacaacttatatagatagggactgaacgctcaaatttttggagcagctagtgtggagttctctcctatttgttaccccctcctcccatctctttcctatgaagaaacaaaatcttaaaaatggaaaaagtctataataggtcttatgattgaaccaagtccagatccttagcagtgagcaatttttactatttagcagttttatagacatttaagtggccttttatgcaaagaaatgagatgatcttttctttcttaaattttctcatttggtaatgttcttcagctctgttactgtgtaactctgtgatcttatggaatttgccttggtattgacctcagatttatgaaacacagtgttatggtgcagaattgaaatcttaagaacaaaagctgtggtcatcgttcttaggtggcttcacatttcccaaagggtgtttgttgtacatcccttggaaacgtaaataggtttttgaaattatctgttaaaagaatccacagattgacatacttataaacacaaacctattcgtagttgtgtcttcagtgggcatagccagtttattgatgtggagattctaaaagccttctgtttccttttagacttagagtaaaatctcagccaggttttgttttttttgtttgtttgtttgtttgtttgtttttttgaagtaacgtctcactccgatgcccaggctgaagtgcggtggcgtgatcttgatcttgactcactgcagcctcgacctcccaggttcaacgatcctcccacctcagcctcctgagtagctgggaccacaggcacacaccaccacaactggctaatttttgtttttatttttgcttgttgttttttgtagagacggaattttgccatgttgcccatgctggtcccaaacccccgggctcaagcgattcaccgatctcccaaaatgctgggattacaggcatgagccatcgtgcctggccttcagccaactcttttttaaaaaacacctgaaaactaaagtttttaaagatctaaagaagacagccagatcccaaaaccagtatgtcagcaaatgtttaggcacagattagtaaattttttctgtaaagaacctaataatattttgggctttgcaggccatatagtagagactatatgttgcataggcctaaatttatggtaagagtactgaaaaaaaattagtgttccttttcagatttctttaaaaggaataaaacagttctctgcagagactatacttgcataggcctaaatttatggtaagagtactgaaaaaaattagtcttccttttcagatttctttaaaaggaataaaacagttctctaaaagtgtttatagatttttttctgatttgttaaagacaagaattagaagtgtgggcaatgtactgataggaaaatgaatctctgactcaatttgcataaatataagggagcttggttcttaggcttaacttctgtattttattacttggcattactacgaacctgagcttcatcttgattttagtgaacttcctttgtacttggtattatatagccaaattttattatggatgaaataactggtaagctatatagttgtattggacatgcaggttccaaaaagtatttagtctgtggattcgtgatgtattggtctatcatgtaagtagagaatcataggcagaagctagtagttacaatttaatgcaacaagaatcttgctaatgcaatacaaccagaatctctgaaataattttgatttccacatagaatgcatgttcctcagtcactttatcataggtcagaaacatattagacttcttacctcctgaatgattaggttgcatggtattccatgtagaaaactactagatgcacatatctacttcacccttctgtagagttatttgagtagagttatatcttctgagtaccattctaagtaatgaagataagcttaatacaaaatatagctctttgaggactgggaatgtttctccacaatggagggacatagctgccagatactgtttccatctaaatagccagtatagcttagaagtgactctttcattgacttaaataaaaatttagtgaattgctgtctttgattacagaagtataaaagatgtggggttctctttcaacatccgttgttgtacttagagaaaacagagttacacttaattcagctgccaagatagcaatttggctaattgtctactgatcatttttgtattttttccagcttcaagacagacattcatgacattattttcagtcacacataaggtctttttaaagccttaatcacacacaaaaatgaatgaaatatattgtatttcttcgacagttctaaatgaaaaagtcttttttttttcaaattatccttttgtgtcaacatgagaaaataaagtagaagttttcctcttctagtgttggcactgctttttcatgattgcttataaaattgcgtatcattgaaagagacattaaaagtatccatttaatttgtgctatatagacagctaagaaaaataaattaatttgccattagaataaaaatcagactagttttcatcctctaagcaacagtgtgtctctaattttccacacaaacccaaaagagcctaactgaaatttctatgtagcctcttctctgtcattgctctctcaaagacacacagcttagtgtaagaaaaaaaattaatttgcaaagtagtatttcagccttttcttaggcaacccaagaaaactttggattgacgatgattgaattgaacaatgagaacacttggacagtggaaggggaacatcacacaccggggcctgctgtggagtggggggagggggaagggatagcactaggagatatacctaatgtaaatgacaagttaatgggtgcagcacaccaacatggcacatgtatacatatgtaacaaacctgcacgttgtgcacatgtaccctagaacttaaagtataataaaaaatatatatataaaaaacaagaattccatcaaatagtgggactaaaattcttcctaatttaactggaaggaaaaagtagagaaggagccttccaaaatctgtcacttgtagtgacagctatggaacccttgataaaatcatgatcatctccttagtgtgctaataaggaccacttgaggtattaacgccttgaaggcatcagtgcaaacatcaaggagatactctgcacaggtgccacagttcctggaaatagtgggaagaatgctggcagggtgatctttccttggcaggggcgggtttgcttattccatttacctacagggtgatttcccagtagtatttcaagctctcacaaaactaccaaacccaggccccaggactccagattttacttttcattgctgggccttgctacaagaaaaactttatgtctaagaagaagaacaccaggcatttatttcttatgtgatctaggtcacactgtcctgtcatgctactacaaatatacccaagaagataagcagttctaatatttattgagtgctatcaagatgcaaggcacttgaatatgtttccttatttagtgcccacacacacacaactctgaaaggcggttattattagaccccttttacagataacaaaacagactcagagaggttaaataaccaccacaagagcaccaagatgggaagtggtctagctaagattcgaacctacacctgtctgactatatagttaatgtgtttttccatcagcatttgctgggtccgtttctgggcaactgtgccaattcatatttgagggaaaacttggtatactggctgtcactggcatgaaccaatggaaaaaaaacagatatcaaattaagattaactagtctttgcttatcttttactcaaaaggaataattaaagcagcaatagaattttcagagtcttcgtattttgaggcctgaatatagttgagaatgtattttatttccaacttccattgctgaagaatttatgttcacaatagccggaggtacatagcaggaggagatagggggataaaatgttcatcaatatacacatcaaactctcctgctatactttacaaaagagtcccagcaacttagtctccagagctttagggtaaggcagtttcttagttcaaatcccagatctattactttctatttgatatgtagtaatttcttaatgtatgttagctgtaattatcattaatattaatcagcactgcagggaaaccatatacaaatattacaatatgggaattcgtgggtggagaggggttcctgtaaatatacgtgccatgattgttcacctaaatgtgaatattagttaagccttatgatagttcttttgtgatttaaattttcataagaataaggagacttttgttttaatatgttttttcttatcatctgaaattgatggataatacttcaggttttttcttgtaaatcatataaagaataaaaccagcagttacagggtggttggaatattactggaacagattccgattattagcccttttgctgcatttgacttactctagtaatttgaacttctctctcagagttctttcccctccctcttgcctgaggtctgccaagtcactttgtctagctgcttacatttgctacccttttaagtagttctggaagtttggaacttgcagcccacatcagcagatttgcccttttgcatttggcaagaatcagaatttgccatgtgtttccaaggagaggtgggagtatggtgttatagagattcatgtcagcatgagtctggaaacagtgattgttagataatcagtgaactgaagccagagaagagaattgagagcattatttttagagttgtttatatctgtagagatctacagcaatgtatgtattgcttttctttgaatatctttaggataaaatgatatacctttaagaggcatcatgtgatgtcattcattaactgaagcttcagaataattgggtctgaaatctgaggtaccctaaacctgactgagctcatgcagtacgttctttttaactctctaaaattatggctgcatgtaactgcttgctttaaaaggatgttagaattaggtgattgtacacttactttctcctcaaaactcaactgaaaataaaagttggtaggccaagggtaaggtagtgctggggaacatgatgttggaacagaatttaaatttcctttttttaaatgatagtttatgttcgtgaaaatatgaccagaaacatttagtagaatgttgacgtatccatgtctgtgaattttcagattactggagtgagagtgacaaggaagaagcagatactccatcaacaccaaaacaagatagccctccacccccatatgatacatacccacgacctccctcggtaagttagcaacaagaacattacttatcaccagattcttctacctgaaacatccttttgtatgttaaaaacatatgtagtagattgcatatcaaatttaaggtttctcagcggaaaagaaaactgggagtctaaaatcaataagcaaatttttttaagtatacaaagaatatttaagcaggaaaaacagtcattacagattccaggcagaataaatatgtcatcacttttattaacaaaatatactgtttgtatgaaggtagccttcgtggagataatcaacaacaacaaaaaagttttcttagaaaaaggtatataaaatgaccttatctattccacactaataaagtgtattcctatgtcctttagaatgaactcataaaaattaatattatatctatattgaagatatttttgcatgtagctttttcagcagccatgggacctggtttaatgtatatgtttgtatggtgtgtcagacaaatctctgtaaattactctgtgtatagactgtactttgatcttttaatagggtaaacagctggtttacttgggactgtcccactttatggccctttcccatcagaattaccaagagtgtctcagtaatgttccagtttagacaataatattccatggtcaggccgggcatggtagctcacgcgtctaatcccagcactttgggaggccaaggcgggcggatcacttgaggtcaggagttcgaaagcagcctggccaacatggtgaaaccccatctctactaaaaatacaaaaattagccaggcatggtggtgggcacctgtaatcccagctactcgggaggctgaggcacaagaatcgcttgaacttgggaggtggaggttgcagtgatccaagatcacaccactgcactccagcctgggcgacagagtgagactgtgtctcaaaataataataataataataatattccatggtcacattgccataagaaacaattctgcctatcttgggactaagtcttccacataggaaatagaagctggatttaggtgacaacaatagctaacctaattccatctcagtattactccagggggataattcatattttctctctttttctaaaacgtcaggatctggacaatttctttaaaatatctataaaagaggaagaataggaaacagcatcttcactgaacagctacttaaacatggcaatttgtgaatttcaagaagaaaactattcatattattattaacatgtgggaaggtaactgactgcccgcagaggatgccaagtaacttctcctcctttaccaggaggagtggtatgcagcttcacctcagtccggtgtgtcctggctgccacctcagccctgtttgtgatgatcacatttaacaaatcaggctcgacctgggccggtgtgtttgttagtccccagagctagagtaaggcttgtggcagtagaggtgcctgcaactatttcacagtgttcacttgatgccagtcctttttctggttatgttttgtgctataacatatagtcccaagctttaaattccagggataaaaattttccatttttcttttatatttatgtgccctgcagtatctatgctcaaggctaatggtaatccctagcaatgtatagtctcatcctgcctaacatttttaaccccatagaaagtaagaccatcagacagcttttctctggcacccataggagcagacattctcctatgaagaaaaggaagggttctttctgtttataggcagcctatcctcatatccaaaagactctctcctagtccccaagcccaagctacatgaaatcaggaatatgaatccagggacaatacttcttcaggatctgaaaatgtatagtttttaaagtgaaatttttgtagttgctgaattttcttatgtaagcactaactcttatacttgcattgttgtaaaattttgcattaatatgtcagatttttcatgagaccttggtatagccgcattccaatacatccatgtctctgtctcttaaaatgtaagctggggcctaactttgagatgtctgcaaacttgcctagtcattaacatgactacgtaagagttcatctacttaaatattacctggtagaaaccgaatgtgttccttggaatggaagtggtctgttattttggcacagactaatcaggggctcctttctacagatgagttgcgccagtccttatgtggaagcaaaacatagccgactttcctccacggagacttctcagtctcagtcttctcatgaggagtttcgccaggaagtaactgggagcagtgcagtgtctcccattcgcaagacagccagtcagcgccgctcctggcaggatttaattgagacgccactgacaagttcaggcttacactatcttcagactctgcccctggaggattctgtcttctctgactccgcggccatctccccagagcacaggcggcagtctaccctgccaactcagaaatgccacctgcaggatcactatgggccataccccttagctgagagtgagaggatgcaagtgctaaatggaaatgggggcaagcctcgaagttttactctgcctcgagatagcgggttcaaccattgctgtctgaatgctccagttagtgcctgtgacccacaggatgacgtgcaacccccagaggtggaggaagaggaggaggaggaggaggaggaaggggaggcagcaggggaaaacataggagaaaaaagtaagtatgtttctggagattcttagcctgtgtacacaaagtcctgaccttttcaaacttcttatttgaagaaaatagaaccttgcttcccttttttcttaaaataatagtattgctatatagtaagttaggtctcccttggtgacctactttcagaacttcagtaacttgggaaaacatgatgagtaatgaagcttataatctcaagatacccacagctggagcaaataatttttttctccaactagccatttgccttttaaggttaatggtgtttttgttttcttccttctcttatccactttattctcacttgcatgcaccatctcactggcccacagtggttgccccctgagttgggttaagaaactataaatgtttcaagcaggttgttagcagagccttggttgaataactgagtatacacacacacccactcacatctatacatatacatatttatcttccctttttattgtcagaagatttaaaggaaaaatccaaaagatagtttttccaaggagagatttcacatagcatttctttcaactccaaatagctgaatttgtttctagaaaccaattttccaaaagcatccatctaatttcttggtatgtgtgttgatcgtaaagctcaatttatgtgaatcaactcttataagaaaagtcaatgaagtaatcctctgccttgttgacattaagaatatctttactagttattaagttctttattcaacatgccataccaagcctctgtttattactaacatgacacatcagtccagaaacccaggctggtttaagggaaaggctgtaactcagttattttagtaagaaagaaaatctaggtttggctacaagtcctgaacataaaatgcacaaaacaaaatatatagaagaaatagtataaaactgttcacatctctttattcaaaatgcagtctgggccaattagcgcagataacttgagcaaatggtgatgaaatcacagttacttgtttggtacccctagggcaatagacttctctttttaaaaagatgaaagcagagtgtagccttcagcccattttacaaatatatgggactttgattacagaatatattagtgtaagttcttcatcacaaatggaaaaatatctcaaagttcacagattaccaacaggtcaagagccccatgtcagtgtcaagcttggctcatttaaaatggtagtctctttggaaatgactgacaagaaaatacagtggacctccctttatggtgtggatcttcattgcattatttaatattatctcatctaccaacaaaatataagaattgcttgtaataaaattcatatgctgtggcagtttccatgtgaagtatattttagccataatctccatgagaaacattataaaaggtacgttgttagtacaggaaaagtaattaccattcattacttgccaagccctttcaacattcacatctatcagagtttatggaagaaatatttaggagccatgttagtcctctgcaggaattctggcaagcataataataatgtttaatattctaaagattactaaaattaataaattgtcttctaaaatttaaagatgagttagaaacttcatttcaactgtcattcaggtactacacaactgctgtgactaagtatgtgaggtttattcttttacaaacattggagaaaacactttatctcagccattttaagataaactgtgttgaaattaggcacagccctctgaaatagagaattctgttcagaaaacatttcatcattcctacaggttaagtcactaatgttgtcttgttttgaataagctaggcacttaacagttcatcctggtcattgaataagggaagagtagaaagaagcaagcgtgtcctaagacatgaagggaaaatatggcaccatgcttgctcattcttcaggtttccagtagtccacagagcacttctagttagatagctttcaatttttttcttctagattatcttttttgttgtttagtggattggattttttagccaaatagatgcactcctaagttggttgggttttttctttacatttcagatgagtttagtgggtagttattcagtgctttccatctttttcagtgggctctctgtagaataattgttataagatagaacagacctagtaagtgtgtcagtaaatttggtattgtactttttgtctttatggttcaatattgtgggatgtttcgtgctatttcagtcagatctgcttcactgaaagtggccttgcactgtctttcaggccccatttctttctgggtattttttccataaatcttgccacttgatttctccgtgtacttcaaactgttcgtaacagagtagtgcattcatcctttcctggaagatgcttattattcaatgaaatgtatgtttgttctaatgatggttttctgcattgctatttctaatatttaggagtgggcaatttgatgaacaccttattcaggaaacatcagctttaaaaaccagtgttttcaaaagaatctttaaggtctagttatgggatgtcatgttcatggcttccctggattgaccattaggagtaagtactcaggctgcttgttcaaatcaagctgtctggtgttatgtcagcagagcaaaaattatacacggaaacgaagctgtggccattacatcagccttaacgtcctgtacatgtcctccaacacagagcgcttactgtgctgccacacagttcagcaggcaacctgtgcttttaaaaatcaaagtccaacagcagtgtgttacttactgtcctgctccaggccagcattcagtttgacctcctgaagtgaattgtagtcatcaagtacagaactgcagaggaaataagtttaatgtctagttccaaacgtttttctcagtttgccaagaaattaaaaataggaagtatcaggtggccaaaagaaataatggaagaaaacatgaaaatatagtctgtcatatgctttaagggtgaagaattatgtcatcaaccaaacctctttcttatcatttacgttttatcttaccttatatcacaatatatgttatatagtgcttatgagcttacagagcaatctaagaagcaagatatacctaaatccatgccttagctgtttttcattttccttatgggtatggaatttggccctgcttataaagtatatatttagccttccttagaacagacttcaatctgtgttctcgtagttgaactaccttttgccttattttgaaattcaattatttaactgagtcatactgtgattttcttaggctgaactcattttagtctgaaatggatggtactaaaagtacacaaatgagacctgtcttgttttcctttgactgaaaagtcagcttgcatattaattgtcttgacctgcttcactgacatttgagaaaagacaagtaatttcctgttatcccaattagcagtttcaaaccttacctggtatggacattataagacatcagctaaattaacttacaaattatgtcattctatgcacctttaaaggaatataaattatgaaagtatgggacaaaatatgaagatatatttcattcagaaataatctgccataacattaaaatactattttggttaatacagcttgaagtcagcttagaaaatctcgctttcctttgccgtatgtactagccaattcagatgaggttttgaaaaccattatcccttaatcctgctgattttcccctaagcaattataagggaactctcctggactcttgatgccttcatttactcggtgaagtcatgatgtcctttatcattgtcttgaagattacctaccagtattctcacttaatttacacgtatatgtagcttgggcttagaaatctaaagcaaaacctaggtcttttaagggggaataaaatctattaccttggagccactgtacacattagattatcaggctgaaatattattgacactttcaaaatgagatctgctgagaaatatattttaaggttatttttaaaaatctagactgagttttgtggctcacgcctgtaatcccagcactttgggaggccaaggcggaggatcacttgaggtcaggaatttgaaaccagcctggccaacatggcaaaaccctgtctctacgaaaaatacaaaaattagccaggcgtggtggcacatacctgtaatcccagctactaggtggctgagacgggagaattgcttgaacccgggaggtggaggttgcagtgagccaagatcatgccactgcactccagcctggatgacagagcaagactctgtctccaaaaaaaaaaaaaagaaagaaagaaaaaaaattagccggtcttataacctgctctataaataaacaaaataaataaataaataagtaaaaaatctaacattctttgtacactattaataacttaggagctgtgtagaatatgccactcagtagcctaaaatcttaaattattagggcataggggctagattatgagtacaaatacagagcagaagatacattaattcttgtcaatcattttaagggtcctatcttcatttcctgaagattttctaaaggtcatgaattctatttttaagaacattaaagtaggagatatgtagacaaggagaaggtattcccagaatatgaaattgtattgaaggaagaaaaggaacaagttgaaaataaaaatgttgcaacacttctcacttttttattatcaagataaattatatacacacacaaataattttaaagagcataatcatcattaatatcttaagttatagttcatgtctaaagggagtagatggagaaggatatacacagtgtgaagaaaaagacatgataaagtcaaagaaaaaatggcagagaaccttaactatatcacttttgtaaagttgagcacaccatccttggctgattatataacaaatatgtatttaaaaaaaacagaaaaacctagaaagtagtgagaaaattattttaatatattgtctgattttgaagaaatactgttagggagacataaaacactgaagattagctataattctgatactggttataggttagatttttaattacacctccattttttggctaaaaaaatgagagaaagttattaacttacaggaagttcagaggtggggttgttctggggtgaatttcatggcttaccaatgtcaggactctccattcatttttctgtaatgcaagagctccaagcatcatttctcatgagacagcattcaaaaagccaaagaccaggccctatctttagtcctttctataagaccaagggaaactttccatggatccttccagcagacttatacccagatttcattgccaaggttgcatcacatgtgcatgcctaaacaaatgacaagggaaatggaatgatatgaacagtttagactaaccttgatttgtttttatggtgatgagaaagagaaatgtgcaaaactgcttatcattactttctgcatgagcagctctattactgtgtatgttttgtcttcaaattatatttgttcaagcagtgtttcactttttaaatatatatatgcacatgcatagcccagatcacatcaccttacttaaaaattttggctctattgaaatgttagatatataaatgaagtaataagtattatgtaaccctgaaaatgtagcaagtttgatataattattgttgctcatggaatgaataagcatgttttcctatagacaataagtaatcctagcttagaatacagtctctggagatattcctcagttcaaatccttgctttgtcactgtcccacttacaactggtatgattgatcaagttatttaacacctctagacctcaatgtcttcattgtcaaatcatatggtaataatacctagcttttgaggttgtgtgagtattcaatgaagtgatgtcagaaagcaccttagatccatatgtgacacattataagtctgtccagtaaatgttatatagattttatataattatataggttttatatttgtttcatttatagattgatataattatatagattttatgtagatttgtattaaggcaaagcgggcaattacaatacttaaatagtgaattaggcctggcaaacctcattaagtaatgtttactacatgtcctatctttgttcagttctagccattgagttgaaccatacgaaatgttgcttttgtaggtcaaaatgatgaaacattagcaattttgtgtgtttcaacctaacatattagctgcgttctaggagtaaaatagaaatgttcctcatttcacattcctatcactcactactcctttcctttttgactttggacatttgggaactcaaaagaaaccttgcattccaaatagcaataattgtatcagatatatttactgaaatgtttatttatagatcttgtcatttgggtctcatttcaaatattttcccctcagagatcctttcctgacaacccagtctgacccagatgcccaccaccaccattcatcctcttgtatggttaccctgttttatatttttcccagctttatcactaggagtataatattaaatattgttcacagatttattttccatccctactaccagaatttaagcttcttaagagcagggattttattcctgtcttatagcacctaaaacagtatatggcccatagtagcccaggcactattgaaagaatgaatgagtgaatgaatgagtaatagctaaccccttttgttactaacttcctttcaattttattatttatagagctaaagttattttatccaacatatgacataaaacaaatcaaaacatcgcagaattcctcatttttggtattttgtcaaggaaaagccaggactacatgtgttcagcataccctctttatgctggagaccacaaagctgggatgctgataactagaattactgctcctcacattatggctgttttatggtcacattctctatgattgaaaccatttcctcctgtttcactgccatttcaaaaatgaaggccacaaaaatatgacatctgaaataactagttcattgtcataaatcagttagaaaccagatcttccagctctcttaggcagttgttcttcccaccaaaatccactgcctgtagaaggaaggaaaactcaaatcactgccagtgcttggttaacactcctagtcgtccattacctagcttcatcttaattagtttgtaaaaagtgttgaaactgcaacttgtactttggcaaataaccagtagccctgcatcagccaggaaaataatctcaaaagtgttagtaagtaatgacatcagatgtaaatggcaaaagaaggaattctaaatgctgtcaagtcacaacagcagaagatgtggccagaagagagctaatgctcacacaaaacaatgtcaacccctcactagcataggtaaggcaagttatgatttatgttatgttatttttttttactgagagagattattagattcagccacactgttatctgctattattttcacacatcaaaaaaaagcaaatcacttctcttcagctcaataatagcatattattcatttctccatggagtaccttctagcttattgtataaaaacctatcattctctttttaccttgctcacccttgccagagaaggccgaaggtcacaaatgcctcatttttgtccctcagcataaacaatttacctcctatggttggttaccaactaccagaagatggtagattatgatttaatatgattgcaccataaaaatatcttggagattttttaattaccctatttttgttgtgtaattcaaaagtaataacttgcttattgcaaaataaataaaaagtacagtgatgaaagtgcaaagccaccttctcttttctttactctccaaagttaactactgtcgaaagttaaggttttaaaaatcaattctggcatgaatttattttccttatatatctctatcttgtaactcagtgtgagttagggatatgaaggatggtttagttgattatcagttagagttcctctaaaacttttttgatatggcgttagtttataatgtaagcaacagtcctgtgaaataacttacgtagcaccttagaatccagcccaatcccaaaatttattactctagaaaatgtagcagttgaccttttcaaaaacaataggagaaatatgagaagaaagaaatggcattggctgtatatgcacactcactcatacactgccccccccacaaacacacccccccacacacacaccccgactcatacatcagaagttctcttgcctacttgcctaatgccttgatgccttatggattttgctgagctttctttatgaagatcttccagtactttcagtttataccaaagctctgtgatgaaagagccaagccagagccaattagaaaaaaaattagcaagtccagccttcaaaaggcagaaagcagaacttggatatgggcttcatagccactgagtctggtgaccagtttacctacggattttagcttcaagttataaaacactgaactttctactaaacaatctctcctatttccagtgttctcactagtttcatactactagccactcagactttcttatgccgtgccgtaggtacatcttggcctaatatttggtcttaataacataatctattacactctaaaatttgtcctttaatgggaaaatattcccactactatgtcattcaataaggaaaaagtgcccattattatatttttaagtggaaaatttgatcttaaaaaattaatagttaaacctcatacttgaaaacttagagcagcttcttgtctcaagaatgacaattttgtatatttttgtttttattacaaacacaaaatatgccaataaaatcaactttctgggttatttcacagacatttttggaatacttgaaaataagagttatagttgtgtaaatcactgattgacttcagagcttttagagccacaaactctttaacattcttactcttagattttctgacatttcaatatctagatttagccagctaaaatgcaaactaagtctctgtatcgtacatatggtttgctgtatcaatatataattcagttaattccaaacatgcattcatgcattcaacatgcatttgtttatttttctacacacagggtaccatgttaagagcctgtctagctcttccataagtctacttacaacagaaatgtgtaaattatttttaataaatgagattttttctttctgataacatgaaacacagagagtaattccaaatatgcaacatctttgttaccttataccagtaattttccctagtaaccagtttataattttataaaaattattcattgagagatggtgcaagatattttatttttatgttaattacttatcacttatgcaaaatttataagactagttaaaatcagatgagatcacttaaagagctatttctgattcagcttattccttaaacatcatggttgaggaatatgcattctggttacccagttgtactgattaacacaaatcagatgtctaaaaatcaatgaactgaacttcatattatactgaccatagattaatgtttctttttataattgagaaggcacttcttaatgttacactataatcattgtagaattttattattggaaaagcctattaatatagggaatattagcagagcattaaatacagaaaattgtattttgaatgtctattttagggaaatttgaaccttaaaattttaaatagtttttcatttccttccacatttgaaatccctaatcttccatgattttgaatctgttacttttactgcactatttctcttttgataaatcatccgtagaatgtatttacttaatgcctaagatctattcacttaagacctccgaattttctcatctatgactttattggctattttcgttataatttttttttaatttttgttgttgtggcccctccactgctccatgactgaatttagtttattctgtaacttacgaaatggacactgtaaagcatacaccttgagattcttggtgagagaaaatagcccataactttgatgtcactaaacttaaactgtacacatttttttcctatcatctctaatgttttctcctgttctttagcaatgccaacacacatgggttcacatgccttttcttaaaaaaagaaaagaaaagaaaacacacggggaggagggacagctggaatcagtgtggctttaatataatacataagcaaaatctgacaataagccccacccctcactttgaattctgttatctttttaaaatcctatgtagttgctgggctgccttctctttatttagcatcttgggttcttagattcatgatgtgcttttattgacttaattaaaaggattttgcctcagcactagaggtaggcaagatgtttatcattacaaaagtaattccgtagaaatactgaatagctttgctgaataagtaactgaaaaggtgccttaactgaatgcttctttaaatttttaagcatctttttttaatgtgtcagtggtatctctctggcaaatggtaaatcactgatttactattaaagatgcttaaatttgtaagcatctttttttaatgtgtcagtggtatctctctggcaaatagtacagtacctattttaaaatgttttatgttaagaaaaagggttcatttaagagatgaattgtttttaactgggcttggcatggaaaatgagtcatgctgtatgtaaatatgcatatagccctctcaccatagaacttagagttttgaggcacttatcttcactttctacccaaaagagaaacttttgcatattttaaaaattgttattgagcctctgcttgaatattttaaagactcggaactcccgcctccaaaagcaggcatttcatgttgaagagccttacttacagagttcttccttgtattgatacaaaaacaaatttctgccaaactttctactcattgtggatcttaaaattgcaaattagaaaaatgcagagcaagcatttgaaagcctatcatgtggaaagatggacaagatagtctttgaagttccagagaacatagtagataaagggcacaaggaggctgattttagattgatatggaaaaaaaatccagtttttgcaggtttataacttacgagtttagtgggctcctcattactcgaagtgtttaggaagaggctgaataaccagctaccagccaggaattcccaagttagctggaaagttcaacctgatggtttcttccaattctaaagttttatagttctcttcagcataatggtcttgccctttgctctcaccatatgccttgcacattgtatatatctccaaaactctaaaatggaattgtgttatcaaacataatttgtgttgtctcttcttgaggtgtctttatgcctgtgacacatgagttctagataactcatcatcctggctaccctcatctggactccttgtttctttatagagtccccatgctaagtgtattggaactattacagtgatctagacactatacttttgttaacatgattacattagttttaacctgctcactgttggctcatataatgctttaatgttatcaagtgataagcattccacttactttattttttaatctaagtgcagctatttatatttatttctgttaaatttttaatgtctcatgtttcacccaaagtatttgactctgttacaaagtttagaatctcagttttatcatgtatgatattactcatttctcttatcatttaataatcctccaaaattctaagcaccctttctgtgtttttaactgattcatcaaggaaagtacattttttaagaaaacattttaaggaagaaaagaccaaggacagagatttacagcattaaattttaaactttttgtgttaattttattcagtcattcaaagtctttatatagatccacctaatagtaatgtcattcagcccatattacagtatctttattcatagggtatcaggtaaaatttcatcttatgtaagacacactgcccagggttttcctcttcccttccaacttagagatactgtccccaaaagaagtcattttaaaatgcttcatttttttattaaattcatattggtttgtcaaacgaaattaaaaaacaaaacgccacccactcatcatctatttttacaaatttatatttatatcaggtttatcaatatgttcattggagaactcatgctttgtttgtttggataagagggctcttaagatttaagcattaagtcttatggaatgctgacagtagccctaagataatttccaaaaagtttattcacttgctaagattataaccttctagtttaaaggaaccacagagtggttcttagtagtcccttgtctccagaagcatttatgttttaatgccctagtttgaagactttttctcttgcaggaaaagcctaaattgtcattgaaggcattatagttctactttttatcattgatattttcttaatttttctttacaaaagctttgtatcttcagttttttcataagcttcagctgaacatttgcctttgtggagctcttcttacaaacaattggtattattttctacttgttcatttctcgtagcctcttattctatattttatagaaatcctccttaaactaaggcttgttctaaagaagttccttgtaactaccttgacttcatctgcatctcctttccctccctcattgggacagtttacgtttgtattactggaatttaattttttaaaagtactgatcattaaaactttccatttgtctttgtaaagttttaaaatcatatctttaataatctaaggtccatatccagctatgtgttctttctcctcaccactagaagaaaaaacaaaagcaaaattacataatgtgtttcttttagttctctttgtgccataaaagttcttccctgttgttcagcattagatcccaaatagattccaaatatttctttgtatttctgaaacatgaaaccatcagggtttaaatgcatgcagtaattacttacatgtattgatctcattttcaatgcattaaatcctataattagtatattgatggcttgaccagaaaatattgaagttcaggttatattattttatattttttcatcttcagaagattttatagaaattgattcaacttttagcctacaaataataggaaacatgacactataaaaattaggtgacttcattaggacaatttacaatatttttaagcctgtgttcttgcatgcctcagtcaataccagaatatgtttgtatagagtattggaaccctacagacctggttggacttttacagatctagtaagagtaagaaaataagagtaccatagatttctaatagtttgtttttgttagatccaagtcctaaccctgatcagccatattctttagtcaactgtattcagtggctcctaagaattatcatttctatactatgccccagtttacattctttataaataatagcttcaaattacagaaacaagttgcattcagacttcttcattttaagcccttttacctaaagtaataatgacttggtagtataaaactgtactaccaatttctgctctaaagagcttatagaaattggggtgatatttgagtatttgtttattagattatcttgctgtaatctatctagtgcaagatacttgctgcctgtctgtaaaagaaaagtatgtttgttgaaggtaatctcttccattatatttttagaaaatacatagtaacatttcaggatgtatggtttaatgaagagtggtgttgcaccacattgttgatgctccttgatattttcacacatagccagtgatatacctctcccaactgaataattaacatagctgattgtaaaaataaacaaacttgatttagcccttcaaaatttatttgcctgtaattcactgagcttatacgtattaaacaaaacatataataggtacttcattgtcatggaacccaaactaaataagtattaaataaaactcattcacggatttataccttacaaaatactgcatattgtcagaagaagaaaggcataggtgtccaaaaattggtttctaattaattataatatggataatttttttaaaaattgaataacttttttacaattccagccaaaatttagcatgtcctccattatatggagcagtgaatttaaaaattactttcatggttttagagtttgagacagccaaattacacaaatgattcactgtttaaacatcaataatatttccactggtggcataaaatcaagcttcaatttctaaaatgtgtatggaaatcctatgcattactgatatttagaactacctttttggtatattgagatgattgatattaatcaggagccctaaatcagttgataaactattttcacaaaatgcagagatattctattttactttgtgccttaaattttaaagaaagaaagaaaacaaaggaaaaagacataatttagtttgttttacttgacagtcagcaaaagtccactaagcagggtgtggctatcatcccaaaggtgaataataacagcaatcataaactggactgatcatatatctgaacaatgcctaaaatctcaagaaccatttattgtacttgcaattgagtgtagtgtttaaaatgatgagaattttgcctacaaaatcataattcctgtggataaagaatgggcacaaactgctatttttctctaatataaaaagaaataggctacctctaagtttgtttttttgtttttttgtttttttttgagacggagtctcactctgttgcccaggttggagtgcggtggcgcgatcacagctcactgcaaccttcacctcccgggttcaagcaatttccggctaatttctgtgtttttggtagagatggggtttcaccatgttggccaagctggtttcgaactcctgacctcaagtgatcctcccaaagtgttaggattacaggcatgagccactgcatctgcccacccctaagttttctatcatgattgttccaaaaggtagaattatgatgtattaatttatctgcctaaccaaacttttattctattcattgcacagtttctaaaatcagagattatcttaaattgacaatatctgacatatttctatattatcccccaatagctcataattcaggtggttgtaacccaattaaatgatagaagccatgaggcttgactgagtaaggtagaatactaattcttattttttcattgtctctaatgaaatgactgactttttagaaaagccatttaatttacccactaatattataaggcatcagatatttttagagaatgcttttttagaatttaaactgactcagttttcaaaaaaagattattaaaataaatgcacatcgtattctaaaagtaaaaataaaataattcaactatttgggtaaaatttggtgactctttttctgttaaattttcaatatttgatggaaatgaacatataatacatgtaacatggcattttaaaatgttaaaacagtaactaatggttatgtcacaatcatatttattttgcctgatccatgtggtacagaaacctagccattcaaaatctgtttaaaggacaaagttttacacatagcaataaagctgtatcaagcaatttggctgcaaccccttccaacatttccccaaagtagcagggtggtgaggttttttatagtagttccatcaatctgcttctatcaacagagaaggacctttagagagtatatttttaagttatatttataattaaaatctcatcctgagtctaagattttgtcttacctcatctactcctaacattaatgacatatgaatatcttgacaatgtaggtcattcaaagaaaacaccctttagcagtggttacactatcatttcatataaggccaaaatcatttttccttgacatagcaagcagtgctagaaatagcattctttgacctcagtgacttatcttcctaagatttccccctctgctacatagttcaccccaaaaactttaagtagatcttctcacttcaattgaaaacctagtgaggtataaagcattttacatagttgtttaatagaagtctattcagtgttcagcttgtacccgcaaatactgagattttgaattaagatgtatttgggcaatttaattaattcaaataatatttatggaggcaacacagtgtcctgagtacccactctgctaagtgctggaagaaacaaagattttaaaattacagaatcaataaattcatcatttaatgggagagaaaaacatacaaatgtaactgtacagtatattagatgttttgagaaatgaacacattaagttctatgaaagcacttaagaggtcttgattatctctaccttgtgaaatcagacaagacctcacagaggatgtgacattcaagctggatgaataaggtttcaccaggagaaaaagaaaaggagggtacattctaggtggtaaaaaaaaaaaaaaaaaaaaaaatggcatcagcaaaggtagacaggaagaaaaacaaagaataatttagagaaatatggtatttagtgtagatgagtacagatgagacaaagatttatgttagaaatgaattaaaaaggtcctaacataccatgtttagaagtttggattgtatcacaaagaacatgatagagagcttcggtaggtcactctggccaatatagatgtattaatgtgggagaatacaggtgatagggataccaattagaaaactaattcaacaatccagatgagagatatgataccctcccttgacaaatgtggaggcaaaatgttaccttctcagaggaagatctaacagatagaaagtaggtcttgaagagtaaaatggaaacttggagctctcctaatgaagaattggatattgggctaaccaggcactaataagaggtctgccaagtagccctgaatggcctgaagtcagaaaacacaaatttagaatggtgacaatcagtgtgcatatacagttttttctagcaatgcccagtggccaggcaggagtaagaaagcacatattggaacaagtacatgtaatacatatccaagagggaattgaggggtctagtcagaggggtccaaattggataaggaaatgaattcaggagggagctggttcttaataagatcaaagactagacattatatcatgaaagagatggaaagagaggaaactatattcagggaaagctgtaatatttaggaagtgacatggcttaccatgatgacaagctcaaatgtgtgttgattttggattagacagcaagaattcaacacagagggcacttattacaaagcaactcttcaatatgactcttttacgtttgcatcttgaagaaaaaactttggaacattttgcacgtgagcgtgtattagtctgctttcacactgctgataaagacatacataaggccgggcgcggtggctcacacctgtaatcccagcactttaggaggccaaggcaggtggataatgaggtcaggagatcgagaccatcctggctaacatggtgaaaccctgtctctactaaaaatacaaaaaaaaaaaaattagcctggcatggtggcaggtgcctgtagtcccagctattcaggaggctgaggcaggagaatggtgtgaacccgggaggcggagctggcagtgagccgagatcgtgccactgcactccagcctgggcgactgagcaagactccatctcaaaaaaaaagacatacctgagactgggaagaaaaagaggtttaatggacttacagtgccacatggctggggaggcctcacagtcatggcagaaggcgaggaggagcaagtcatgtcttacatggatggcctcaggcaaagagagagagcttgtggagggaaactcccatttttaaaacagtcagatgttgtgagacttattcactatcataagaccagcacaggaaagacccacccccatgattcagttatctcctgttgggtccctcccacaacccatgggaataatgggagctacaagatgagatttgggtggggacacaaaacatattattccacccctggcccctcccaaatcccatgtcctcacatttcaaaaccaatcctgccttcccaacagtcccccaaagtcttatctcatttcagcattaactcaaaagtccacagtccaaagtctcatccgagacaaggcaagtcccttccatctatgagcctgtaaaatcaaaagcaagttagttacctcctagatacactggggggtacaggcattggataaatgcagccattccaaatgggagaaattggccaaaacaaaggagctacaggccccatgcaagtccaaaatccagcagggcagtaaaatcttaaagctccaaaatgatctcctttgactccatgtctcacatacaggtcacactgatacaagaggtgggtttccatggtcttgggcagctctgctcctgtggctttgcagggtacaacctctctcggctgctttcacaggctggcattgagtgtctgcagcttttccaggctcactgtgcaagctgtcagtggatctaccattctggggtctggaggatggtggccctcatctcacagctccactaggtggctccccagtagggactctgtgtgggggctctgaccccacatttcccttctgcaccgccctagcagaggttctccatgagaaccccgtccctgcagcaaacttctgcctgcatccaggcgtttccatacatctgaaatctaggcagaggttcccacacctcaattcttgacttctgtgcacccacaggctgaacaccacaggaagctgccaaggcttggggcttccaccctctgaagccatgcaccaagctgtaccttggccccttttagttatggctggagtggctgggacacagggcgccacacctgtagactgcacaacagcagagagaccctgggcccagcccacgaaaccactttttcctcctaaatctctgggcctgtgatggaagggactgctgcaaaggtctctgacataccctggagatattttccccattgtcttggtgattaacattcagttccttgttacttatgcaaatttctgcagccagcttgaatttctcctcagaaaatgggattttcttttctatcacttatcaggctgcaaattttccaaacttttatgctctgtttcccttttaaaactgaatgcctttaacagcacccaagtgacttcttgaatgctttgctgcttagaaattcttccaccagataccctaaatcatctctcaagttcaaagttccacaattctctagggcaggggcaaaatgcccaccagtctctttgctaaaacataataagagtcacctttgctccagttccccacaagttcctcatctccgtctgagaccacctcagcctggatttcattgtccatatcattattagcattttggtcaaagccattcaacaagtctctagggagtgtcaaacttccccacattttcctgtcttctgagccctccagactgtttcagcctctccctgttaaccagttccaaagtcacttacacattttcaggtatcttttcagccgtgccccactctgttggtaccagtttactgtattagttcattttcacactgctgataaagacatacccaagactgggcaatttacaaaagaaaaagctttaattggacttacagttccacatagctggggaagcttcacaatcatggtggaaggcaaggaggagcaagtcacatcttacttggatggggtcaggcaaagagagagagcttgtgcagggaaactcccatttttaaaactatcagatctcatgagtcttacaagaacagcatgggaaagacccacccccatgattcaattatctcccacggggtccctcccacaactcgtgggaattatgggtgctacaagatgagatttggatgggccaaaccatatcaatgtgtaaagtaagttatctaatggcaagagggaaacacccattgatagggaaaataaatcccatttatattaacagtatttatgtattacatttcagttgtttagtgaagtatattcaatgaccatataatgaattatgaagaagtgaaaactgaagctattttaacttgctatttccattctaaagcaaatctcaactcatttcagtcaggtttacatcattaactgatcagtctttgaataaaataattttaaatttgatatcaagggcattctgaatagaatgactgaattatatttatttgtccttttactttcactgctgtctcaggaagactcttcttatgttttctatagatgatacctctctgttaaagtcaaagacattttagtgatttatcttttttataaagatatgccacatagtctggatttgaaatgcagtctgcaaagccaggcatgcccataaatctgaatcttttattcttttctcatatagaaaaagaagatatttttacacatggataaaaatactaaagtagaattgcctttctcaaggtaaagccaaaacacctatagtgtgatgcagtttgtttaaattttataggtttgttgaacacattaatctattacaaataatagctaacatttctaatgagtacttactatgtgtcaggcactattctaaggtctttacgtaatataagtcatttaatccttacaacaaccctgtaagggaaatactattattatccttatcttctaagtgaggaaactgagtttaaatagcataatccaggactcccagctatttaataacagacctaagattcagacagacattgtgacagcagagtgaacactcttaattgcatattgcccctcagacttataattttaatacaggttaaaatttagcaaaatatttttcactatatatgtatataatacacacacacacatacatatatatatatattgacctacataaaaggaattaaaatttttaggttttattacagcagcaccattaatatggttaatcaagtaaagcaaaaatgttgttctgatctttcaatcacatttacaaaaatttaccttttattagtagaaattataattagtgtactttccaattttaaccagtgtccaaaaatcatgtactgtgatgtgtataaacagtgaaacgagtccaccacttgagtcaaaaccctttcttagtattttaagctttgacatgattccttttatagctaatttttaatattgggatttttttttaaaaaaaaagaaaaactggctgggcccagtggctcatacccagcacttcaggaggccaaggcaggaggattgcttgagcccaggagttcgagaccagcctgggcaacatggcaaagccccaagtctacaaatacaaaaattagccaggcatgatggtgtgcacctgtagtgccagctactcaggaggctgaggtaggaggatcacttgaggatgggaggttgagcctcctgtgagctgtgatcacaccactgcactccagcctgggcaacagaacaaaaccctgtctctaaataaataaataaataaataaaataattcccaagaattaagtctggatactggtttgaaaattatttcatatggtgactaatcagaagttatttcaatttttccttcgaagttctactttatacattttgtggaaacaatccaaatatttctgcctatttatttatctatcatttggtggagatataaagcagtagatttatgagtaaaattcagagataccactgattttaccaattcctactcacagatgccaagtctgatatattgtgtgtttctgtgtattctctcatgatgaaacattacttttaatcacctcttacaaatcggaagagtaaatgcatgtaacctgaaaagaactattaaagaatgcaacattaatgctttaatctatttccaccttctaatatctcatgcagtatgtagaataaaataaaaactcataattctcacatttcctgcatcttctttcaagatattgcatataaaactacttcgtaaagtagaaagtgaaatgcaaatgttagtaccataattattattaccgagctaacatgctaaattggtttgccttcaaaatgttaacaccaaattgaagagtaaaagtttttcagtgataattcttaggattccttgaaaaaagaatactaattagaatatatgatattttgcaaaaacagcaatacctccattaaattcctagctcctctttaagaaaaccagattcagaactagtgaataacttattacttttatcccatatgttctggcttttgattttacatcttagtaataagttgatatgggtatctgtaacccacccttcttagcaggttgccatgacaacctgaggtaaagtaccagttcactggagcttcaggctttgtccacgctaaatacaaaagctgcatttgatttcagcttggccgtttctgttgggagcaatgtaccacagttctttccacttccctggctgactttttcatcaccatggagaccagatctgcccacacaactaagatgtgaaaccattcctcatatggctaaaactaaggccttggttcccaaggccttttttaaagtatattactttgttaaagaagagttcctgcttctgcttttaaagtgtttattgattttccacaaagagaaaacaaactttctggtgctgaagatttaaaataaggagaaagaaaatgacattttccttggtcagtttctggttttgtgtgtactgtattcatggtgtgtactctgcatagtcaattactaaggaataatgtttcatttcaaattatatgacaatattcctaaatagtagttcacacatttaatgttcacttgatggtgggcttaaaatgtgacttttagtttgagatttcctaaatttgtcactaaatccaatattagtatcttttagattagttctgcacttccaataaaatcagtatgagaagttattctagaaccttgatcataagtatgcatggacttaaggaagaactaatgtaatttatcactacaaatccagttatagcatatccagatagatctgatgaattagctatagaagatcatatagcccaatttttaatatattcttgcatatgtaaatttgtaatgttagtatgtgtatataggtgttcatgtgtatacacacttatataatatacacacacacacacacacacacacacacacacacatacagattagtaccacaaatagggtcaaagttccacagagttctttgaagatcacatttgttatggagatactaaatactttacagctgctattatttttttgccatcccctcccggaaaatggcatcagtcaaaggagatggtaggaagtcttaagtggtgttgggaatcccaaattcaccccttgatttgcacattcctcaaagtgacttaggatggcatctcaactttcatggttgtgttttttaccctagagaaggcaacatggcccttgcttaataaaatacatatactaaataggaattccaaaaaattctgacttcaataaaacatagaattgttcttattttttaaaatatattatgaataagctagcaccataaaggtgccgtaaattagtttacagatgggaaacaaatttattaacataaatgaattttttgttttgtttactagcaagaagttagcaatccgttgctatatttgaatacaaattatgttgtaggatacagagaactttctgacatttcaaacatttgaattttgcaagaggaactcactgcaatgaagttcctgtatcattccagttttctgtaattacgctggagagtgtgaaattcaacatgtgatactaaatgttaaacacagatatagctgggaaccttttgcaatggctataaagtcatttgtatttttccataagaacattgagagtcagcatatctctaactctttagtggaactttctgtaaaagggcagtgccatataattttgtcagaagggaaaaatgaaaattaatatacaatagggcatttttaaaaaggatattcttcatatgttgttagattcaatagctttccatcccaaatccaagatgactttgctggtccaaaatttaacaaccagcaatttccaagacagctaagattgaatatgaaaactcattacttgatttttagttaagatgaacattaatgctaatttgtttacatctatgctatatttcttacaaacatgattttgtagtgatttttaccaaattaatgtttttcttcttgtcatgtacacaacatattttgaatgcctaaaaatataataatttgaatgttggaataggcagatgacttaacaatggggatttttgaggattgtttatgatgtaattattgtagattagaaaataaaagaatgtgaaaataccatggattaaggtgagagattagatttataacaaatttgacataaagaaaaaatcttaatgataaataactgtcaagatacaattttagattcttacaaatgtttcttgaattttcttcttacctttctttggcacttgccttgctggggaaggtatctttcattgtccttaaattcaactggcagtgcccctaaagcagctccttcttgccagagttgctaatgagcaaatgatcccaaatgtcagactggtgtgccaaggaggttattaataaggcattaacatttagaagttattgatggaggaaaatcaatattaccatctttataatattgcaagctcagttagaaagagtaagcagaagtttatttcaggcttctacaatcataaagaatgttacagtatgggaggaagtaatgtctttagatttttagcataagaatcaattcttattctgctgtcagtaccccgcattagtactggagctaatgctgaatgatattcttctaataaaaatagcagtaatcctcccaaaatcaagatggcagtactttgaggatagaatatgaatttaatatgagagtaagaataggatggactagacctgtaggacaaaagttcacaaagatctatgttatatatatatacatacatatattcatttattttagtgtgtgtatatatatacactaaattcatattctatcctcagagtactgccatcttgattttgggaggattactgttatttttattagaagaatatcattcagtattagctccagtatcatgtcattcctcacgattcaattaggtaataaaagaggtactgacttgcaaaagtaagtgaaatgttaaattcttttcaggaagaatacaacagatagttctgcttgtgtgtgggggagtgctgacagcagaataagaaaagaattgattcttatgctaaaaatctaaagacattatttcctcccatactgtaacattctttatgattgtagaagcctgaaataaacttctgcttactctttctgagcttgcaatattataaagatggtaatattgattttcctccttcaataacttctaaatgttaatgccttgttagtaacctccttggcacaccagtctgaaatttgatctaaaataaatgtgtgtgtgtgtgtgtgtgtgtgtgtgtgtatatatacacatatatatgtatatgtgtatatatatatacacctatatatatgtatatgtgtatatataaatatatgtatatgtgtatatatgtatatatgtatatgtgtatatatatgtatatataaatatatgtatatgtgtatatatgtatatatgtatatataaatgtgtgtgtgtatatgtatagatcaaattttcaagacttaggaagctgtgccattggttgcttcccaaagaagctgagcagtaaaagtataatttgcatagcattaaaatttactgaccacagatcaagttagctgatcagcatcatggcagaagtatgtaagggcaaagtcctttgtttacttggagtgggttctgatgaagtgaacatactaaatgtatctccataaccccaactccccaggcacacatacccttatctattatttcaccagaatatcaatttggaaaattcaagtcgagtgtgatggacaaattaaatagcgtgggtcatagatgtataatcagtgttctgaagacatttttaccacccagtcatataagtgaaccaagattcagataaggttggaactacttttcagagtacttatcaggtaggaaagagaatgtcctaatagggtttgaaggaccaaaaagaacctattaaaggaaataggcaagaaaactatgttgatagagttgatcccaatttgccttttcattttgacagactagatgtagtcacaaatgaagtgttgaatgactcacttgttcaccagactggcagttctcatcactgagttacttcacattgattatcatccaggctgaataaaatctaattacatccttttaatacaaacatacaaggtggtggtagaaaatccacataaatttaaaacctgcactgttcatctctaaagtatttgggagttaaaaaaaaaaagtctactattttctgtcgggggttcatgtctcagacttcacctatgttatctctgtaggtatttcaactggaactgagaagtttaaggagattattttaaattaagtcattattcatcataaaatggatttcagaagcaacccaatctgccaatagcttgctgtccacctacattgctgaaagaaaaccttacccaggaatggttatttttactaaacttgtctcattggagtttaatgtgattcttctattaataacctcaaaataacatctcctgaaatatttaaaaatatggatggattaggatggaggagtcaaatatcaagtcaaatacagtagataattcttaactataaaattttaagatagaagtgggaaggaggtatacaactatatcataatctttttgaggtgagagtgttgtctttgtatatttattcctaacctttgatatagtatatatatatatacacccataggcacccattaaacctttactgaacgatatatttctataaaaattaattatttccattttccattttaaaatctgaatggcgacatttgcaatgacagtatcatgtgtcaaaattccatagtacattttcctgaaatatctacagacacttcattgaaaataaactggttgtaaattaaaacaacatgttaagtacttctgtaactattaaatgtgaaagatgtcttcagttgtttcgtaaaaacttcactcaaagggtacttcagatctgccttaatttcagaaagttgtttttaatgcagattttagaaagtcagcatgtgtgatagactcctggataagtaattaagtcataaatggcactctaaggtcataatataacagtaggtggattaagatgaaatactactttcataaggaaatactccatgtcttgtgatttatacacacaggatggaattgtgatttgggaatttagaggaacactcaaattatctggaaacagtattttcttacctgttttgcctatggcttaggttcatcaaatattttattttacccggaattgtgaattaaagaactccataagtgctgtaagtataaacacaaactatattatctatcactagttaccactttatttagaaaaataatattttatcatgaaaattttgcttcacattcataaaaatattttccaactccttctccctatggtattaaaaaataaaaaaaatctttaatatccagtctttttgaagtcaaccttttatgagaaaataggccctcaaaatttggacagataatactcaaaccacaattaacaagtctctgttttggtctgaacattctgaaccaaggtatgagcccactgtctccaatacttacatagagaaaagtaattatcactatcatttcatggtgttggatatccttgtttttgaaaaagaaaaacttaaatctaagcacatacatttagaagaaggggaggctccaaataactatgttaagtaaataaggtttttcaaaataaacacaaaacaattctactctcccaggagtagaattgtgttactcttgatagacttgaatatctgctattgatgacctttgttatccacaaatagcttaagacaagtagtccttggctttgcccttaaatttgccctcaagcatgctgattatggaactgagtgaaatagaattgagttctgtcttagaactcaaacagaattaggaatctttgtaagtgctcaactggcttaaatacttacttccattttaaaatattttcttctctttcattcattaaagaaaatatttattttcaactgttttatatttagccttaatcattttcttgaagatgttcgtacctctacccttatcccctctataatctaatcctcctcaggcatttgattgaagtatcatcagctatttttagcaggtcactaatggaagcctgattatatttctaaaacttatgtttccagaatttctatttcttcttattatttgggcggtcaagttttatttggggcaatgtttaaattcataaagcaaaaagagaaagaaacatcctcctcaagatttcctatgcaaattcaatctgtgtctcaaggaacttgcatggatatggaatctcactggaataagtcattctacacatgattcaacatggcattccatctgggttcatcattcagatctccaggagtatagtaacagggaaacaagatctgtttcttcttaacctaagctggtggcctcacaattagaagtttcagtgatgagtagtagcttaataaatatttattaaataatacgccaaacagaagcattactgattttctttgtggtatcatagatatgttgctctcatttcaaaatgtaattggctaaaagcttggtaaatagtgaaatttattttaacagcagcagtagggaatatttttatagttagagtaacagccaaaagaaaacaaaataatcaagagttatataatttatgttttttctgccttctattgttttttccatagagatggggtctcactatgttgcccaggctcgtctcaaactgctggcctcaagtgatcctcctgtctcggcctcccaaagtgctgggattacaggcatgagccactgtgcccagcatgcctttttctaaagaacatgcaatttccatttgttcttttagaaaagaggaataaaattagtctgtataataattttaactggtttgactattttgactttgtatcaggataaatgaagttgtccactacaaaggagaagggtagtaattgagaattgaacacaaagaaagagaaagcccagtgaaaacctaaagggagagaaaaggaaagagtgttgagaatcagaatgggacttgtaaaaagttaaagacacataaacatgagattcacagaagtccaagatagaaggacagtatcttgaagtaggtttttgtgttttagagatttcatctagattatacgggcagccctttgtgcacttgcttctgacccacctggctcgccagtacacgtatacttaagattcgtaatgcacatgccaagacatatagtggagttgagtgtaggagtgccgttgtagtttcttgtttgcctcaaatataaataggcactatttaacactacataaaaagtatagttctaaaaaatttatttaaaatttaccaaggcctctttcattttgccataatctcagtagaccaagatatttccatcagattcctcagcaaaaatcctgaaattgtttaagctgtgtgatacaatgtcagactggtgatgggattaaaaataaaatgctatgtgaagtccccaaactcagggcttctgacttagaaactacttgtatatgcagtgcaaaaattgctgttactccaaccagccctagccagtgtgattgacctaaagcaagaggtctcaaactgcagtgggcacaagaatcacctggattgcttgtttaaaatgcagattcctgagttccatacccagaaattctgattcaatagatgaggtgtagggcccagaaatctgtgtttaacaagcacctccacccccatcctgagattcagtagtcactagtactgtgagcactagtagttgaagagataccgtgccctagggagttatcttctcttatgctaactaactggtagctagttgtagccattttgaaatagtacttctccctccaccatcccttaggagctaaactgaggagatgtttccagtctcttgcaatagaattcggcaattgtgactcgattaccagggctctagttcagtttagtgtgggttaagtgggcattaaggaatgtgtattagaaattaaaaggttcatgtaaccttatctctgtggggaaacaaaggatgtgtttaggataactacaaaatgtttgaattgcttagataaattaagaacagtttaaacttagaaatgaccttgtgcccaaggttggattccctctgattttgctgtgtgaaattccatgaccttgtgaaacaaagtggtagaagctaaagctagcattccagtattataatattctaaaaactgaggtattgtgttttgtttcgtttgacctgtatatgaagattattcagtttccacccccatttctgcaaaaagagtataatattacagacaaaaattagttccgctgatttctgaactatgctatatcttgtttgctagatatcagtgttataggcaagatgtgtccctccccattttctaagggaggacataatgaacaacatgctttctctattctctctcccaacttgttccttcttttctcaatatgactcaaaagatactacaagatgttgcagataaaaatctgcactaggctagagatttaaaatattgctgatttgttcctgctgacaatatttattagattcctcaagatccaaaataaaatgacctaaaagagggtacagtttgttttatccaaattgttattagtttctcaggtcattcagaaacatccatctcttccagtttcttaactccttggcatgtggcttatgctcaggtgtaaagtcaccctttcatcacattcactctgtcttagcttttcgtttcttggcattttgtgttgttaagcatgcggcctcctcattggagcaatactagctaggctgttccactgtctcactgattaggacatggtagcatatatatcaggtcaatcaaatacccttctggtcagaagactagagaggttttcttcatgcttcttgattagatgaatttgaggaaagatctcgtatagaaataattttaattttctcaaaagaaatggtaattttacatgtatatggagaatattttaacataaactattctgattaaaattatagatgtacatatacaagtatagtggtgggaaaatatttttctgcactgtgtgttattgtgtatatttgggagattaacatttccaaacaaccaaagtttaaagcaaaaggtgtcccatttatggccaagtagacttgcatgccaacagaaagacattgtattaaaaccatatgcaattctagccatatttttctactttctcttcatgggtattgcatgatggtatttctaatacaaatactaatatgctttggaaataatggcactcgcaggtctttcatcatattgtatcactgctttatcatattaggctaatacactgcgagagttggtagaacctctccatgccaaatcggatccacttctgttggcactcaacccattggactcacagattgataagctaatgtttagagaatttagatcggagagagtcggtacggcgcagactcaacatcaacctcttgcaagcaactaaaatggcctcgtccttgctgtttataacagaaaacagacttgtaaaaagcttagatcatcaagtgttttggattgggggcctcccaaagggatataagaggggcaggccactcttaagaagaatgcgagctttctacattgggactagcataagatcaaagccaatcaagatggagcacagtaacagaaaactgcggtttctgtgggagaacagaaggggaaagggtcttaactgggaaagggctctgtgtggtaacacctcagttgtgttctcctgacaccaggaaaagagagggatcagcttcaataactagaaaattctggctgtttaatggactctttggtggcctctttaaggcaaagcagagaaagcaaattatgtattaagtgtattttgcatttttaaaacttgacgtgctgtattgtactaaattaagtgtaatctattaaggcaaggtatacacaatttgctttgaaacttactatgtttattctattataaagtgtattcaggtgcaacacagagactgctttcggtgacattaatgaagaaaatttctcatgccaggctttattatagaatcttcagctaaaatcctaactttctccttatttcttggcacttgtatacaagtggtgttgcctcttagggcaggcatgagctattcttttctgtaaaatattttgaatctataggctgtgggtttcatttttgaaaagtattttgtctggatgtctttcaaactagcttcagatattatttaatactatgtaactgggtcccctatggctcaatcaatattgcttatttttcttctgtagtggatgtgaaatttcctttagttggataagatacactgtaataattttaatgctaattaatgatatttcatactgtgcaatgaacagataatttaacactgtattttgaaatgtttttttcttcctgtcaccgcagtgtgtggtattgcataatgtgaatacctgtaaaaatataaattacttaaaaataaaaatatgaccaattggtatcagatcttttcagatagctaaataatttgctaagtatgcctgatagtaaatatctttctaaaaagaagtaatcagtgcttctttctcacaaatggaatttgtgtctgtgaataaaatcacattgatctgccttacaattgcctctgtgctctaaccattttaatgtgttttttaaaacatatatatataatgatggttctggtatatagaaatccatcaaaaagcattttattggctttattggtatttaatatttatgggattgtcttgggtcattctccctgtttaagccatagtaaaattttgtgatctagagaatttggtgttttttttttcattaaggaatatagtgactccacattaattttcaaaaataatcatctcttagctttggttttaaactgtctcctttatgaattcctgcctgagagccagcactttgacttccatattcctagtggttaaattttctaaattctgtgggtaaacctaaactgtcatttatatttttgattgtccttcaaagaaccttcccttctttggggcaataaatcaatgctaaggacaccaaggttttgccatctgaactacttgtcgtaaatactgtagtgccctgaaaattcaaccactgtcatgtatttttatcattaaactgcataatttaacagaaattacatgttcagagaaagaagtatagaataaactttagctctatctcttttgtcacatctttatggagcaatatttagtgttgtaaggaaggaattgacagacacaagtacttgatttcagtgaagcacattatcattattacaaggatgggctttacatgttctttaaaaatacagttagcaaatgttggtggagtcactcaaactgttcttttaagagaaggggttttttctcactaaaatagacttctttactcagagaaattatttcccaatagtaatgtttgtgtattgttactttgcctaaaagaaaataaataacttacccctaaatatgaaactagtagttgattacagatggaggactaaaagccagcttttaaaatcttatgctttttttttgatataacaaactgccttccccaaacccagttttataatgctaggcatagctgattgacttacataaaagcatgaattaagagagctagtatttaattacaaacattcaaattatagtataaacccctgaatacttaatcatccttatcataaaacctccaaagacattaagtccattaaaagtttgtcaccttacatataaataaattattcattatggcttgctagtaaattcatattcatggaaaatattcgggtgttctcaatgcaaatgttagttgccttttgtgacaagaatagtgtttcacatacttgatatcattagcccggaagccttaaagcactctgcagctgtacaagaatgaatgtctctcaaatctgactatgtccagtcttctctaccatttgtgatttagtctttcccaaccttctgggctcattacacagctgtattgcagaaggaacaactgtttccacaaggatatcattgtccaattttacaagatcacagatcccttccgaaatatgtaccagaactcgttatccatcattggcttcattcttcaagagcccaattggtttacttatttgttttgttttcattttttatgctccttcaacattgtcattgcagggatgtgaaaatggggtggatactagagtaaaattttaggttgccaagtttcatgaacaatatgatacaatagattgtcctaataattacacagtcacctgttagggaaccctttttggagtagttcatatataaagaaaaccatcactctgtttgaatgtgttgggttgcatgaggcactgtgccaggtagaagaaggggaaatgcaaatatgagtgggacaaattctactcgtggaaaagtcacagtctaagtctctgaagtagggcacacaagggtccattaaggtacaggaagaaaaagcattggaatttttccttgggttttatctctcatccttttgaatttctttctgtgtatgttttataacttctatctattactatagagtaatacatgtatataagtttctgttcgataaaacggaagtgttttaactaataagagtgtgcaatcagaaaaagtttggaaaccactgagcctgaatgtaagaaatacgtcaaccaaagactttttggtatttgagaaatgcattatgatcttctaataagcaatgtgcaagagattccaacaaactggtatttttcattagctattcttttctttgggctttcagttatcacttactacctagaggtcataggcaacctgaaaaagacaaataatgatgctcactacattcctagattcacaatatttcatagtggagcagaatatgaaagggacaataaagaggatcttctttcaccccgtcaagtatgacacagccataaatgaccctccctcggcacagaatacaagttaattcatcaataacttaattatgatcctcaaatccatcaatcaatgaaattttatgtaggaaagaaaattttatatgcactctttgcttcaataaaattggaattcaaaagtatgtaatctgacacaggactaatttacatgttgtaaacgtaaatataatttggggggaaatttatttctgcataggcccaggtttcctgaataaattagatacagattaaaatttcattatagcagtgatacagttcctcattaggaatcacagaaggttcctatatatgtcctgtgatttgaatgtggtctctacactttgccaactttcagaaaacattcattcaaattgcaaaagagctggttttcagccagtgttccagtggctgaactggcacattgaaagaaagtcaatcaggaagcagacctcaccaagtgcttgcctcctcttccaaagcaagcctcttctaaaggaagaaaaagcaagggttgaaaaaagagagaagcctgaagagaagtgagaaggagatgaagaagagggcaaaaagagaagaaaataaaggtgctttcatattttcagttgcaacagtagccccaattgacttaattggtattcatctgagaaaaatcaaggaaaccaattgaaaattataaaagaaaataaaggtctgtttttgtcttgaatgttgagttctgtgttgttttgactgttgagcacagtgaatcagatttataatgtgactctgcccctcaccaaccgcccttttgaaaatgaaaagactctttgtctagtcttaaaatgttaagtaattggtggcattttgtggtagcctggcatctcagtccctcgtccttactcatcccactactgtgtcttgtgtagtgtatgtgtatgatgtgtaggggatgggggcagggggtggcttattatctctgataggagccacactatcccattactatacttggaaatgtttctgtgttccgtctcattgtgattgcttgttcaagtgtgctgcccagagataaatccatactcaattctttttacagctgtcaaaccagattctttgtagaattatgttgtcttttgattgaatgcttttctcccccgtaagagcaagaagggggagaaactttcagtttttattgtttaatacctatgtatgtcattttatatattgaatcttcattcatccttcttaaagtaaaactacattgaaattttataaaatcagttatctgccccagtatttcacaagctttaagaactgagggaaaactgggtcaaaatgtttttttaaacaaaatatatgtacccttctacaatgttaggtaatatggaggaaggttcttttaaaataaaaattactatgtaaaaatactctgcctcccttaaatcctaaaactaaaatctgaatccctttttccttcaccttctttctagaaccaaaaaactaataatacattaggccacctgataccttaactactataattcacatctgttaggcctcgcattttctaccccaccctctactctatgaaattacatctggctttagatgcagtattgccttgaggaaaaaaagaatacgataactactatataattcctcagggttctttcctggcctatgattttctgaaatagacttatgctgtttaaatgtgtccttgtttttacaactccatttagttattctaaatgatcatatgattttgtgccttcctcaagccaaatcattctcagttaagattccctatcttgcttccattttgttcataacccacaaagcagtttctcctttttacagtcttccatcccccatccctcaaaatcctctaggtgttgaatatattcagcgatgggccaacagagaatttaaaagctgttatttaaagtgatttttgtatttttagattatagttctaacttagatatatggttaagaagttaaaatttatcacagaggacttagtgatagcatgtgctgatgataacaaggaattttctaatagaaggactcaatgactatacctaccattggttgttaacttcagtagcagagccaaaagttgaatgtggaatttaaataaagctgctttttaatcctaaaaatgacctttttaggttaaggtactgtacattttgggttttttgatagttttagatacagtcattttgaaaaattttttgaatgctgcattttaagggcgtctcacattcattggcatctactgctaaatacacatttcaaaagacaactgaaaaaaattggcagtatagaattcttgttaaaatcgtggattctggggtcagactgcccacatggaattctagctccgccacttactaagtgtgactttgagcaagatactgccctgctataaatgaagataaaatagatctgctcttagtattgttgtgaggattaaatgagatcataaagattaagcatttaccctgctgcctggcacatctaaatgttaaatggtatcattaccaattaaggaatctttttttgaaactgtcagaaagcctaaaatattcacatggaccattgtggaatgaacaacattccatatttactctttgggccaatataattatttaaatatgattctggctatctatttaaaaaaagatgatatagccctactccaatctaccactccaagcaaaatcctagttcatctttgtttatcattgttgagaaagatacgacattagtgttcaggcaattataaaaaacaagatgggagttttatttgttcagctatgtctaagacccttattgagccagtctctcatttttttctcaaaaatatttaactggagtattttctcctcaggtcttacaaatactaagtagcttctcttagcacgtgccatattttccctctatatttgcatataaacatattcccatgtttcattttaattaaaatattgataatttatgatcagttactatatttacaatgtacaaggcattactatggcagtcacatgaaacctagtaatcctctatggcacaattggaagatttttacaatcaaatatactccattgaatgccattcaatcttatgaaatctggaaaaatgtaaaaatcagttcattcagtattgctaaaccaggcgagctctattaatcagcatttctatgcttatcagcataatgataagggatgtttattaatgttttaaaatataatgtgcaggattgtttccatgttgtgtgccttttgtattctaattctttgaacttgctggactcaagatatatatggcaatttgctatcaagagtatatttggttaatcaaataatcctattatttgatcattctaaaacaattagctgcctgtagctaatgttacccaatataactagcagctgtgggtttttgttgttgttttttaatataatagtgttctcatggtcattcattatcctgtttttcagatagttttgatattttaataaattttccatgtgtcaaataactatattgcaatgaattcatttctctttctctctctctctctctctctttctttttttttttttttttttttttttggatgttgcaggtgaaagcagagaagaaaagttaggagactcattgcaagatttatacagggcactggagcaggccagtctgtcaccactaggagaacatcgtatttcaaccaagatggaatacaagctatcatttataaaaagatgtaatgatcctgtaatgaatgaaaaactacaccggctgagaattctcaaaagcactttaaaggtaagacaagaaatggaaggacaaatttctttgaagagattcattcttaaagtggattaccagatactgtaggttaagaaatacaaattgggggctggggagaagaagaggcaagcagtaagaacttgaagctgagctatttctatgtcataataactatattggtaaagaggagatcatcttaacttttcattaatgtctcaaagcactgattaaatgttattttactcagttctaggagaaaacaggatgtgatttaaattgttttctaaaaatgcagggctggtgttattcctcagtctatagattttctaagataaaaataccatgtagtgtaattattagcattactaaaagaacacagcatgcatgcagaatacaatagtgggtgctaaaagagtttgagatatttcgtgattgtttcccgcatgaactgcagtgcatttgggatgaagccacggtgatttgtgttccatgtagaaattttataattgttctgtttacgttatcagttcccaacttacatattaccctcctattatacatttctgtaagtgtttacattgcctccagtctccttattatatgcccccaggttggggaggaggtggtgaggacaggagagcagagaggcagaaagttggaaaaggaggcagacaagtgagccctgctcactgtgtgtgggggagtgtgggagattgaaggagagggcccaccgcacaagccacctgagcaggccctgtgcccttataaaacaaaaacagaagacatttatgcagccaacaaacatgaaaaaaagctcatcatcactggtcattagagaaatgcaaatcaaaaccacaatgagataccatctcacgccagttagaatggcgatcattaaaaagtcaggaaacaacagatactggagaggatgtggagaaataggaactcttttacactgctggtgggagtgtaaattagttcaaccattgtggaatacagtgtggcgattcctcaaggatctagaaccagaaataccatttgacccagccatcccattactgggtatatacccaaaggattataaatcattctactataaagacacatgtacatgtatgtttattgtggcactgttcacaatagcaaagacttggaaccaacccaaatgcccatcaatgatagactggataaagaaaatgtggcacatatacaccatggaatactatgcagccataaaaaaggatgagttcatgtcctttgcaggggcatagatgaagctggaaaccatcatcctcagcaaactaacacaagaacagaaaaccaaacaccacatgttctcactcataagtgggagttgaacagtgagaacacatggacacagggagggggaacataacacactggggcctgtcggggggtggggggctaggggagggatagcattaggagaactacctaatgtagatgatgggttgatgggtgcagcaaaccaccatggcacgtgtatacatatgtaacaaacgtgcacattctacacatgtatcccagacttaaagtataattaaaaaaaaaaagaactatcatacagagtatgtgctgtagtaatttcaggaaacagaaggtcagagggctcctttgggaaatatttcagatccatagcatgctgctgaggttttgtaattttgaaatataggtgagtaccaaagagacagacaaactagaaaatgacctgaaaaaatttcagatagcaagcagcaaagttttcagactccattagcttttaattggtagtcatgcaaatactactgcaaatccaggggacaatttaatggacttttgggaagagcagaatttttagagagtgctgttaatagtcgtaagaatagttgcagtgactaatcctactccaaagatatcatcaccctcccaccttatagagcctctccacttcccccattcagttctaaactgcctggtttagaaggcaggcaggcattttgaagcaggttagattcatggatcttaaagacctgtttctctccttctatctcacagccccttttccctgtcttttatgctctgtagagtcccccagggtattttcttccagtgacaaaatatatggctactgccaatgttcagttcactaagtattgatgaatcaccaggtacatgaatgctccactcgattctctgggaccaagaaagataacgaaaagtcactgtaaaaaatgtccctcattggtacaaatgaactacagaaccctatggtttttggcatggaaaattaatagggaatgaattccttcattagggaagcatagctggccaagcaaccctggatgtgtctatttcctggaattttaacagtccccctcaccaagcacagatctcagatcccaccacaggcaactcacaacatcctcagtcccagccctcttccatattctggtctgtgaggccagaccaacttcttaaccaccttactgttttctttgcctcccaactctggctggcccagaggtgtatgccttacttcctgcagaacattttctacacttccctaagctttacttgggtcaggactgagctgctcagactttcttaacccctacttctccatcccaccttccacctgggaaattctcatcttccccaggtgatagttttaacttggtgagttataccaaaatgaagctcagtcttcagctgagacccagcttccaacatggaagggagagccattctccattacaggcccccagtgctacagaaagggagccataacattcacacagcaagaattatgtatttgtggtaacaggggggccatgctcagtctcattcaagtatgagaagcttaccataaagcaggagaaatagaacacatgcaaaagtaactcaagaaatagaatatgacaaatgtactcagtggcactgatggagtagtaaaggggcataaatgagggagaaaacttttctgagtgtttaagcacagcttgaagaaatgagaggcttttgaactggatcttaaagaacgaaaaaggtttccatagcagagatgggcaaaaggacaggcaaagagaaaaagcaaaccacacagtgggcaaaaggaggcgttcctcgggtgtagaaaaaagtacactaggacgtgagtctaaagagctgggtgggtgtgagtatccaaagccatctcctatgggcttcttaaatgttttgcctattaactttttattttaaacttgaataaaactttgtccctgtcttaattgttgaatcctttttcttttcaggccagagaaggggaagtagccattatcgataaagtcctagacaatccagacttgacatctaaagaattccaacaatggaagcagatgtacctcgaccttttcttggatatctgtcaaaataccacctcaaatgacccactgagtatttcttctgaagtagatgtaatcacttcctctctagcacacactcattcatacattgaaacgcatgtctaaatgtattctgccttcagaccatctagtacctgctggtactctgaacaagtatataaggtagtttttatatcaatgtgtggaacacttgacaagctatactttaatgttaccaaactatatgaaacaaaccatatatggtcacaataccactatctttaatgagcatttgtatattttatatgcaacagtgctcagcttatgtttaccatgtgcaaaatcaactgtctttaatgacttaaaattaacttttgcaaacaattctaaatacaggtggtcttcaagtagtaaaaccacaaaaggcagttttctatctatggtcatcttttctccctttaagttaattttatataaacaagacttcaaaagtaaatcacattttttcaggtgcagacatccttgtgggtgggaaagaatttaaaccttttttatatttattaaaatgttctaagaattttcttaaacattgcacaaagtttaatgctgtagttttatttttgtgaaatgtagatgcgcatacaagagctaagcaaaatagaagagcatcgacataagaaaagttcaggtatctaatattcgtcttaatagtctattaacttgtgaaagctaagttaatggaaatattattccaaatctatgagaacacttggtgtatcagggcaaagctttgtaagatgtttttgtaactaagaccaaaattgaagatagagctgctttattttcttggtttaaatcttcctttatttttgtagtgatgagatgctgattgtgtacagaagaatttgagaggggatttttaaaaactgacttaacacacccagaaaggcagctaacagctatatatatatataaatttcagcccaaactcatgtttttaaactccaactcttaaaagacaacaaggtataaactgaaatgaatcaactttccacttagtttccaattttcccctagtccactaattaaacttaggtaattatacttcaggtagggaagtacaatatgtttagtttcaggctgatgtgtgttataaaaaacaacactgaaaaataaaaatgtacttcccttctaaggagcaagcaggtgatggtcattcaaagagatgtcacattgaattatgagagaaacaatttagaggtttttttcctggcttcatgaattgttctatagagtggatgaagtctaaggaaaagtcctcttcatatatttccatttataagcgtcttgtttttgaaagtgatcacagcatgaaaatgactgtgctgctttttagtgtctggctgcataatgtacaagtcacaatttgctgtttttttcaggaggagaaagggaacctcctttactattctatatcctaaaatctacttctaatcagctttatactgttgcctgtacagctcagtgaatgtactttcatctttaagagttcagatatatgccagtgaatatttttgctgtagaggagaaagtaaaaactccacagcggggatctttttctttgcttttgaaaccaccattgaatcactatcgttttgcagactttgcacaactgtacaggagagtggcctttctacagcacattttcagtaatcctatatttagtcaaaatggatgagaaatcatgtattaatgtttgtatggaattttgggtccagtgtaatatttttatcatttaaaaagaactctatttgtaaaaacatttatttactgcatggatattgacgcacattaaatttgtgggattttgtatatgtaaaaaaaaaaaaaaaaaaaaaacaaaaaacctcttgtcctaaaatgaagtgtgcttgttaacaggtgtttagacttattgatgtttactagaccaaatgtgtatgttcacttaaaaatatatgtacctgatggatgtgtcatgtttacagtggccaggttgtggcctgtaaacagcaagcagttgacgggaagactagctctgttgctactaagcagcttttacttttgtaaagtcagctctgttgttttaaatggtaaaaattaaactaatgaatttgacaagactcgtggctagcctagcatgaaagagaccttttaacactatataatatctgtacattttattgcattcgtttcaaatctaggagagaggcagcactgtaaactgaagtcaaataaattcagctcttaatgaatcctta

SEQ ID NO: 5535 - DNA, 279833 bp, human; identical to SEQ ID NO: 5534

SEQ ID NO: 5536 - DNA, 38241 bp, human
aaaaaccctttctcacaagttgaatgcatctgccaaaaatctgcagaattttataacaggaaggagaaggagtggccattatgatgggaggaccagccgaaaattgccaaacgactttctgacctcagttgtggatctgattggagcagccaagagtctgcttgcctggttggacaggtaaagtcttccgcatgtttcataagtatcctctcctcagacaccagtttgaatataacattattttgcattttgttgtgaaaggattggacaggcagaggagtaccaagtaataaatgtctaatgatgatttaccacaatataggggtattaaatagatattagtcttttataaaatttgatgtccaactaagtagccaatcaataattagtctgacaactgtaaaataccttgctgctttataagcaaaatcattatttggctgtcataataaaatttataaatttttgtttattataatactgctttgtgtcctgatgttctttattcatattaattggttgtacttaaggaaatgaccattgggattctataaactgttttaaataggtaattagacactgacaccttcatagcatgccttgtatgtctccttggcctcgcttcattcattctctgttattaattacattgtactattttggatatcataaacacacttttagacttttttaagtttagttgactttcatttgttttggaacacataaaatagtataaaagtcttgtaatatgaaatgaaaatgttagatttaaattatatactgtatgtggttaaacattatcatgataaaacacattacaactgtttattaaaaaactaaacaaattctctactttcagttttggaatttttggtaaggggtatgtactatgtttaatggcttaataatcaaattttaaaaatgctctttgtctttcataagaaactctgataatatacattaccagaattctttcttgaataattgtcagtaggatattcatatgtgttcctacacacacacacacacacacacacacacacacacacacacacgccagtattacattttggcattttaaaaacatgaggccttatattaaaagtaaagcttttgtatttttaaggtgaaaattgagataattttccttaattttatattgtctaattttatatatacttatacataatataaagtgatgatactaaatccaaatatgaaacactaaactatatattactagctttttgataattaattaatggactacatgtttattttgcattataacattattaaaatttaattttcataattgtctaagccacattatcaagtgtttaaattaattgaattttaaatatatacattccaaaagttatgaatggtcagtaagtaaaatatggcttagtccttaagtactattaatataatacatttgttttggtaggctttacagtaatcagaaggcttaaagaacacatccttgattataattgtatcttcttttactctcattttccctataattataaatttgctcagccttgatatctgcatttagtaaattcatttatatattttttaccctagtatttgttagatggatagataaactgttagagtgaatagaaaatgtttttacttcttgatgacagatatggctatttataaaatcgcacatttcccacactatagtagtccttgagattttatcgtatcaattttttatggtggtattactttcattatgtaataaaatgcttttggtaagtgccaaatcacctacaaaacacatatgtgcatgcacacctacaaaagcacataaaaacacacccagtgtgtcagtgcagatttgctttaatttgagggatttaaaatgaaccctgcaaatgaatactgccaagcatttgatctttaactttagtttattccttcaatatacaatactttagatgaagaataaaaattttgtcagttaaataggattaatttgatgttataagcacctgttttcatttttaaacagctataagttttatggcattacaaaatttttattacattttggagaaaacgtgtatccacagcaatatgttttgggtttattacagtttttattttatgtcacttgaaagaggagaaagaaaaagaaagaataggttaaaaaaaatctttaattttattctagatgctgaactagatgctttatacataagtatatatactctcagctcattgaattctcacagagcagatattgttatctccattttacatatgaaatgtgaaataacttgcctaaagtcattcatctagtatgaaagttatactttgaatttatttttgtctgacattgaagtcctgttattttttccttcatgttcctttatcatgctacacctcgttttgaatgctgactaattcttgaggattttgaggaagggatatggcatataaacctttatttacattttgctatttctcttcaaaagctaaataagactaccacttttctgttttgggcctcagtatctgaaattgctacatagaacttcatttatagaaaatgtttatttcactgtttatggtaaaagtttactattttctctcatttttaacattaatatttaattctaattgtttctaaaatacctttcaagattattctattttaaagggatcattgaaatatttttgataacattgcaaaacctttaaatgtttagggcgtaatagtgtgctaggaaaataatatttatgactcacaaaaactccagtttcaatggagcttccatttaaatgagatacacgttcaaagaccagctccttacatttcctaaataagataaaatctaaggttaacacaattccattttttctcctatttaaaatattgatttcagtgaaacaccagactttcccagaggaatagtctcagaggtgaatcacagttggtagctttactgtttattttcaatgcatggtttacttgtctgtttttaacctacatcctactgtttttgacacctcatatttcttgcagttttctgtggctttgccaaatcgatctatactcagaagtttacagatcactacaagtgttacgttgtacagtaacattagtaaaaatgttcaaaattattattaaacaaagtttattttgcctttcatagtaaaagtttttttccttcatttttaccagtaatacccaattctgagagtttataaaatacctttttaaggtcatcctgttttgatgggatcagtgagatctcttgatatcattgaaaaccttttacatatttaaggcataagagtttaaggtactagggaatttttgttaagatttctctgaaattttttgtcttatgtaagaaaattgttaaactaatttcttcttccatgataagaaactaaaggacaaattaattttataccaggaaaaatattacagagaccaagaaaaccacatcaaacgctaccagataatgtgatccattgtttggtcttattttctctcatgtgctcattgtttctcacttagcactaattattcaagggaagagcagtgacattagcactaccattattcacagactaccctaaggtttcagcagtgccaacctgagaaatagtaaggcattccagattttccttattaacctcttagctttccttattagtttctaatttgtttaggatttctgaatcgttaataacctttttataaatgtaatacttttgtttagatataatgtacaaagaataatttcttatagggtcttaaacttttgcaccagagagaaatataagcatcgtattatctatatgatgatttaaggagtacagtcgcttaatttttaagatttaaataggataattcctgtaacagccacttatcgatgatccaaggattttatctttttttctctttctggcatcaaaaagctttcttgctatgaatttaatttcctttaattagagttattgtgttcttcttgtaagtaccctgaactctacttgaggatttcttcagacttaagaacagtttctttatttttgtttttgtttttgtgtgtgtgtgtatgtgcatgcatgctgatcatgttcagttattctacagagatctatcgtttttactctcatagatgatcattaagtcatgactgagtgataatctttggtaacccacaaagattggagccccacctgaccttttacccttatttatatgtagatacagcccaaatcatcataccaaaccttaaaatctgctggctaagaatggctgttagtacagttgtatatgatttgcctctaagataaaaactttagggtaattctaaatcactacaaaataaaatctgttttccttggtatgtgtttagatttttcttttcattttttcttgaaatttaatcttgagtgaaaagcttgtcctacttaaaatatgaatggtcaggaaagtggaagacatgccttggaattcagtttgctataggcatttagtgatcaaatagattttttcttttctatatttgaacatcaagtgagattcttttaagtagttatggtaaaacaaaacaaaacaaaacaaacatgctgtgcatcacctcatcacttcttaatgaaattttaagattttataaacagactctgaccttttcaaacctaggaatcgaaactcttttctaatcatgccagaagcacttttgaattcttagtttaaaatgccagtttttatgcttcaatgcagcaaaaatggtctctatgtagttttttttttttttttttttgagacagtctcactctgtcgcccagcctagagtgcagtggcgtgatctcggctcactgcaacctctgctgcccaggttcaagcgattctcctgcctcagtctcctgagtagctgggattacaggcacccgtcaccatgcctagctaatttttgtatttttagaagagacggggtttcaccatcttggccaggctggtcttgaactcctgacctcgtgatccacctgcctcggcctcccaaagtaatttttttaaattaatgatattctcctagaagtgcttatatttttcattaaaaatatttttattgaggcctaatttatattctataaattaacctattttaagtatacagtttgatgggttttagtaaattttgataacacctaatacaaccacctttacaatccagtgttagaaaacttccatcaggatggatttttaacagttggtttctgcttacaactaaagaggttaattttttttaactgacaattttgattaatcacatttttttctaattcagttttttaaattcttatgtctccttttatttaagtaaattatcttgaaaaaatatactgggtttaggagtaggaatagataagttcatgaaagagagcctataatacactgtggtgtagtcatgcattgctaatgataaggattggcaattttgttgttgtgcaaacatcatagagtgtgcttacataacctagatgatacagcctactacacacctaaactatatggtatagcctgttgctcctaggctagaaacctgtacagcatgtgactgtactgaatactataggcaattgtaacagaatggtaagtatttgttccatatctaaacccagaaaaggtacagtaagaatacagtattataatcttatgggaccattgtggtatatgcggtctgttgttgaccaaaacgtcattttatgcagcacatgaccgtatatagaatcatttagaaaacaatatgttaaaaccactagaaaaagaaagggccatttaataaattgtagtggggcgcttggttaagcctttggaaaataaataatgatagagcactatctatttttcttcactaaaataaattttagatatatcagatatctaagaagaaaatataaatttacaagaaaactagaaaaaatataggcaaaaatgatttctagatgtggaaagactttctaagtatttttaaaatggaataaaatacaaaggaatgtactgttgactacataaaaaagaaaaacgtaataaagtataagacagaagacaagctgggaaaaatatttgcaacaaacagatatgaaaagcagagggttaatgtgtaatgtgtaatattcatatattaacatatgtgaatattcatattgataaaaaacaaagcccaccaaaacgtaacagatgagtatataagtaggtaaatcaaaaaagaagaaacagaaatcactggtaaaatgtgtatatcaaacaacagagctttaaagtgcatgagcaaaaactgacagaatgaaagaggaagtagacaaatccacagttgtagacttcatttcctctttctcaagaatagataaaattaaacagaaagtaagattagaagagctgagcaccaccacctaagaacaggatgttttgacatttttagagcacttcatccaacaacaggagaataaaaattcttttcaagtacccattgaacattcaccaagatagaccatatctgtatcataaaacaaaattcaacaagtttaaaagaattgaaatcagataataaaatgaaactggtaactcatacagcacacttataagtaatccaacggtcaagtctcatggaaaataaaaagtaatacattgaacagaatgaaaaaagaccaaatcataatttgtggcacacagctaaagcagtgctgaaaaggaagtgtatagcactgaatgcttatatatatcagaaatatatatattcaaaatatatcagaaatatatatagtaaatatatcagaagcactgaatgctttatatcagaaaagatctcaaatcaatcatttaagttcccatctcaagaaaatagaaaaataagaacaaaataagtacggagcaataagatcctcttaatgataagagcagaaattagcaaaattgaaaacaatagagaagtcaatcaaaatgtaaaggttaatgaacaaatattacagataacttcacatataaatttggcagctcagatgaaatggtccaattccttgagaaacggtactaaaacaacccaaaatgaaatagatactctgaataatcccataactattgaagaaagtgaatattacctagaaacgcctcagggtgtggaaaaaatctgcaggctcaaatgatttcattgttgaattttatatatttgaagaagaaacaccatttctataccatctcttccggaaaataaaggcaggaacttttcctatatcattttttgaggcaatcattatcctgatatacccctcccccccaaaaaaaaactacagaccaatatttctcaggaacttagatgttaaaaccttcaacaaaatattaccaaactaaatctaaacgtgtaaaaagaattagacacatgactaaatgagttgcttcaaacacttgaagatacatcagtatacaggtccaccatttactagttgtgtgaccttagataagtcacttaatctttctctaccttatgcttctcctctgtaaaatgagaataataatagtgcctatctcataatagttgtgaagattaaattacctgatacaggtaaagcatttagaatagtaactggcacatagtgagccctcagtaaaccttagcagttgttattactagctcttgattgtgaatattctaagtagatactgtactcagaatcttagattcttttgaaaataaactgacatgttatctttgcctaaagtattccttttttgttttagatgtagtgaagataccttgtaagaaccaaagaacttaaataattaagaactttaaaaagagagaaatttggtagaaagcaaacattatatttcctgaatttaattttcttccaatcatttctttcaaatctttccttaaaataagtcctgaatatttttatcagtatggaaatttcagaacaatttatttcatattattgataaactcattttaggctactatattttgggacttttcaaaagctgttactagtaatcacaattttccttttccctttataggtcaccatttgctgctgtgacagactattcagttacaagaaataatgtcatacaactctgcctggagttaacaacaattgtgcaacaggtattagctgacaaactttccttctgttaatttattagcaacttcatattccaacaatgggaagtatcctatgtaccaagagtttttaagatactggtttagaagtttctcaaagacaaaccattctaaagaaatgaaatgtgtagttatttattgggagactgtgcatttagctcagttagcttaccagaagatataaaaggaacctgacctgtacacacacaaacaaatgtgcctaatagcttttaacagtgatctaattacctgaactgattttccacttcaaatattatctaagccagggatccccaaaccagatgccttcagggtccagcagctaatataaatgtttaaattaagtccggtataaggcaaggagaaatggaagagacttgggtgaattgactggaacatatcccatatccaaacatatcttttagaggaaatgtaattataggcatgatatattagtgcttgtaaattatctcttaaataatctgttctttttctactgttatgtgatgatatctcttttcagtaccaagtttttctgggctctgtggtctcttgctaccagtagtagcaagaagaataaggattaataggtaaaataatgaaataaaatagttaagtgtttatttctttatggtgaaactatgggtgattttatttagactcgacttttctctattttccaaatgaatttttattttctaaaatgaatttgagttatcaaaaaacaaaaaagaatgttaagtacattgaagaaatacctctttaagtttgccaaaggaacacagcttagacaaatactgaaattatactttaaaataaattacatagcttacgaacagttaatgttcatctaatcatctaattcagccattatatacatactaatcactgcatttgattggaattgtatgaagtatctgaagacaggaattaaacttaagctgccagtaaaagaggccaatttgaataagcaaggtgtagacttttaaaaaaatctaggacatgcatttattaccaggctttcaagaaatctcttctgaacagttatgatgatgattatgctttgaaatatgctgtgcttcaaattatttttcattcagctttaattatttttattccctttgcagcaagatgagataatcaatatctaaaaataaactgtcacaaatggcttttttccccttcctaaaacaaagtggtgctactatgaagtaaaaggaaagtgcttcttgatattggccacttacatttaaaataatactaaaattagaggagaaagttaatgtcagtttcttttgaaaacctccatttgcaggaatttgtttaatctgctatatttattttacttattcccagttgtgatgggtttggatcattgtatttgaagccttttaaagagatttccgcccccctccccaacactttcctcatcacataagattggttataatgacacttttgaaaaaaaaaaagagaaactggttttaaaatcttaaatagaattctcacaaagaactgaagcttcatttagaacactgacagcaactgaatcagaacaatgagacaggtacccacacactacttgtcagcctttaaataattgccatgatgccttccttaatggatatcagcttaacctaaaattattctactgtaccatttttatgttctccacttcaaacacaaaaatgatgaattagattgccactagttaagaaataagcacaaaagtgttggtttgcaagatgaaactttggtgaagcttaaaatacatggggcaaggttgtaatcttggaagatttgagactcagccctgtttttcatgatgattccacattggacaaacgatgtcattgttttcgccatctgtaaacagaaataatcacctctacctcaaagtttttctgagaaccaaatgagatttatttaaaaatagtgaagacttagaatcaacctaaatgcccatcagtagtagactagattaagaaaatgtatatatacaccatggaatactgtgcagctataaaaaagaatgagatcatgtcctttgcagcaacacagatggagcttggaggtcattatcttaagcaaacttaacacaggaacagaaaaccaaataccatatcttctcacttataagtgggagctaaacattgagtacacgtggacacaagggaacaacaggtactggggcctactcgagggtgaagggtgggaggagggtgaggatcgaaaaactacctttcgggtactatgctcattacgtatgtgataaaatctgtacagcaaaccccatgatacccaatttacttatataacaaacctgcacatgtacccctgaacctaaaataaaagttaaaaaaagtaaaataaaataaaatagctgatgagtgtaaagtgaaaaacaaagatgaaaataatattatttacaaaaatgggtaaggaataaagagacttgataaaaggaagtaaaataggaactttgttttgaaaaataaatgtcagagatttttttctccatttggtgttagttttcatgagctgcatttacagtgaaatctgaattaggtgctgagggaaaaattcaaacatgttaaagaacattttaaatcagattttgaagtgttaaatacagagtgaaaaattcctcttaaaactcaagttttgatgatatgctttttacctgaactggtcctctctaaactgtatttattaaaaatctctgcttgcttatgggtctgttcatttctaaccttcttagatccattttacatgttcttggttatcgctggttgtctgaatagtgttaaaaacattttacagaaaactgtaaggaagaatatttacaataatccaatcctaattacgcagaaacaattagtgctgttgctttggtctttcctgtaataaatgtctttacttaagttgttattctggctttctgacagttcttttgttttactttgttccatatttacctgtcagatgtattttattttctaaacctttgttcaagtaaatggacaaatattctttaaacatcagtattaaaaatttttatttttgatggacagcctcctttaaattatgtgctttctattcacttgtgttacctttatattattttaaatacagaaaataaaagtaaataatttatgaaacatcctctaaatctgcatcttaaaataaagatataaatgagcatattgagtatatagccctttttaaatgtattcctgctcaaatgtaatataaccattttatctgttttatcttaagttgttaattgctcaaggtaaatacttgagaagataagagtttttaggacttattgaattgggatttgtgttttaactgcttagagcacaaatttgtaaatactgtttagaaagattataaaattttgttaaaatgaatagcccagaagtaatttttagtttcattaaggatttattcaaggaaatttagcctgtagatttattgattatagatattatattttacttaattacattcatgtatatgaatagtacttcatttaccttcttagttgacatttcatatcatttactttcacaatttatggcaaaatagtgtagtgggcactgacatgaagtagatccaagttcatcatcctggctttgcttttcaacaaacagtataaacttggacaaattacttcatatctctgatattatttttctttttctgtaaaagtggatccctaccattttttagattattgttgggctgttgtgaagattagaaactgatttagcccaccatctggcatatagtgggagcttaataaatggccactcgagttattttgtgtagcaaaagagcctttggaaatgctaaactcagctagtttctcgctccacagaaaatttcaaggagtgatgctctgcttacttttggtattgagtggcaatgaagaaagatctcatttctaaaatgtgatttaaaaaaaaaaaaaaggattttagtataattcagaatgttctttagattttaatgcaaatttattactgtgcttcattttctgcaagatatgttgaaacattcatgttcaaatgtaatacagaaattaattttgattacccaggaatgtatcatctctattcacatattcaagttcaagtagtaaatacacgtaaagatgtaaaatggggatataaattatgctggagtaggcaaggtacgtattctatcgttcatatggtaagtgttgaaagcatatgaaaagcctgtccagaatggtctcacagacatttaaaacacaactttaaatattacttttactatgtactcagagttagtgtttaaaccttcctgaatcagacattctgggtgacctgaaaattatattggggctcttgagattgaaactgggacatttcagaccaaaaaacaggacaagctttatatgcatttttaaaacaatatggattatattagcatactcaattaaggcaatataaaaggtgaatgttttttcacttttttcttttatttttagttgacacataattgtatatatttatggagtacagagtcatatttcagtacatgtatacagtctgtaatgatcaaatcagggtagttagcatatccgtcatctcaaatatttgtcacttctttagggtgggaacattcaaaatcctcttttccagctttttgaaaatatgcaataaattattggtaattatattcattctacagtgctatagaacactaggattttttcctcccgtctagctgtaattttgtatctattaactaatctctccctatcccctcctctctcctacccttcccaacctctaataaccacaatctactctctacttctatgagctcaatttttttagctttcgcatatgagtgaaaacatgtaatatttatctttctgtgcttgacttatttcacttaacataatatcctttagactcatccatgttgctgtgaattataggatttaattctttttatggctgaatagtattccattgtgtacatataccacgttttcttcatctattcatctgttgattaacatttaggtggattccttatcttggctgttatgaatagtgctgtagtaaacatagagatgctgatatctcttggacataccgatttcctttccattggataaatacctagtagtgggattgctggatcatatgatagttctatttttgtgaaatatacattctgttttccataatggcactacaaatttacattcataccaacagtattttttcatttcctttctgtttaaacaaataatacttttaattcagttcaattatactttatcctttaatttttcttcagccttttactttaattataaagaagcaatatcttttcaaattttccgtataatgctaatatagtaagtcagaagttagatataaaactatcagaaataatacccagataacttgaatactttttttctgaaaaaaaatgtaaaaactaaaaatatattgttttcaaaactgaaggaatgttatatatgtgcacctgtatcttctcaaaggtgtgtgtatgagaatattatcaaaatagatataaatacacatacaagaaattctcattcatgatattaaatacctaatttttggcagctgcatatttctgaaggctcagaatgaagagataagagtgatgacatcattgcatactaatacttagcaaaggactctagaagagtggggcataataacttattattcctgcagctttctgatactggcctggcttgtgagcaaaaacttaaagacttactgtgtatcatattaatatggatgctgaaatagattgttttcataggtttattcttttataaaccaaaactatattgcatgttatcagagtcgccctgccaaagcgcttttaaagatattatcaccatcaataatatcagaaggagaatagatgagggtgtactaaactcatcaattccttttagatagcaaatagtagatcctatttctcagacatcttctttcttcactgtattacattttgaaatttatgaaatgtacatacatgcaaaagaatgcatatatgtatgttatgaagaataataataaatactcatgaatctgccctctaattaaataactacagcattaccaatattgtttcagttacttttgagctcctctcccatttcatcagcttgcctcctcaaggtgtttatcattttatttgttcttaaaatagtttcagatacttctctaaatgtatcatttgattatgcttgtctttgagcttgtaacaatgctgtcactctgtttcttactgttttcaatttatgtatttctgaattcatgcatgttttcctctgtagctgtagttcattcattttcactgcatataatattgaattctgtgcattatgtgcataccccaatatgattatccattcttcttatcatggacatttgggtatatacctacatttaagtgtaattactaggagtgtaattactaggctatacagtttgcatatgctcatctttacagctgtgaatatcatgttctcaaaattttattgcttattatgtcttgtactttcattatctttctactatctgaattactgtatttgagtcctattatgcagttcacctttgaagaggcttttatagttttctcacaaagaccctaagaagaggtaacttttacctttattcctatactacatatagggatacagatgtagaaaggtgggttaggctatttttgatcctcatgagtgataaaataaacttcagaggagagtccctgatatgctaccatttgtgatatactgtgactattctttttaaagaaccaagccaacagtaatagttcatttaagaaaagatttgctgtgacagacttggaagcaggagtagtccccatgctcttctgtgtctccagtgcctggcaaataagtgtttgttgaaagaatgatgtaattatttttcccttaaaagttcaccaaaaatgattacagaaatttagaaactttaggagtttagaatcaagtaaagagctgtttcaaagcactgatgcctgaaccccatactggacccattaaattagactctttgtgatggggtttggcatcagtattatagaagtgatgcctcaagtgattcaaatacgaagccaaagttgatagcaattgtgctatactcatactttagaaggagacaaatatgaggtgggaaaaaatgcatgtaattaagaacagtgtttcccaaaggaaacactggaccatgtttccatggaccatgattcatctaaggaggcatactaaaaatgcagattctttagactttaccacaggctgaatgattgagaagtgtggatcaggaggttcaattatttataggtgataacagcccagagcctatacatttataaaggagtctggttagttttcaatttataactgtagttattagtgggttatagtccctctgtagtaaatacatatccaaaaggattaggcgtgttctatgaaacatcaaatataagttattaaataaaaagtggttattgcacacttgtaataagaaagagagaaccaatgctagaaagtggtgtggtggtagtagacaggggaaggcactaaggttagtaaaacaagaagcaataataatcattagtaatgttttaagcatttattatatcatattgtaccatacatgaattacatgacatagattttcatacctacacaagatgaaagcagcaaaccaaataaattatagttactattaggttggtgcaaaagtaatcatagtttttgccattacttttaatgcttattatgtcttgtactttcattatcttcctcctctctgaattaccatttttgtcatatgtcataatattaatattacttttaatggcaaaaaacacgaatacttttgcaccaacctaatagttataggcactgatttattaaggcatttcgcttctgctgaagaagtagtttttaacatcccagtctgcttaggttgggtcagaatgaccaccaacatcagataggtaattcaaataaaattaggccctaacacaagtaaaataatggattgaaattgtaaatgacagcggcaggttgaagaactggtcagaatcaagtaattaggacaagtgagcacaaatcaaacttataaaataagtcaaaatttatctgttaaaaccagattgggccaggcgcgttggctcatgcctgtaatcccagcactttgggaggccagggcgggcagatcacctgaggtcaggagtcaagatcagcctggccaacatggtgaaaccctgtctctactaaaattacaaaaattagccaggcatggtggttcatgcctgtaatctcagctactcagtacactgaggcaggagaatcacttgaacccaggaggcggaggttgcagcgagccgagatcacaccactgcactccagcctgggcagcagagtgagactccgtctcaaaaaaaaaaaaaaaaaaagccagattggaaaagactagatttgcaaggaggtagcagaatgtaaccttaggttgactgtgggtaacagtatgtgaggcttgacatagcaccgctaaaaaaaaacactaataacccatgaaatgaagagatacagcctggaaaattaacgaaatggttattgcattaaaatctgcattggttaggtcttcatatgcacatctgtcttatgtttcccttctattggtgcagagttgtattagtcaaggtatactagattatgctgcagtgacaaacaacctgaaaatattagtggcttttaataatgctcatatcaaatgcccatgctccatgtgcatcctgggttgctatagctttactctatgtcctattcacttcaaagcccaggctgatagagtagtctcttctagaaaattgctggtcatcatggcagaggaaaaagagaacatggtgaaccatgcattggctcttaaagcttctgcataaaaatgagacctaacacatctactcacaattcactggtcaaaacaagtcatatagccatgactgacttcaatggctcaaggaagtttacttttccctttaaaaaatggcaggtatatatttggaaatcataatacagtctgccacagcaatcaatctatgaagaattccagtataacattatactagaattttgaggacaacaatattttttatttgaatgtaacctctctctcctcaatactgaagtgtgtttgtactgtgtgtgtgtgtgtgtgtgagacacagagagaaagaggatcagtcggtattttaagtgtaatctgctggaatatgactggtaggtttcagtgggggacaataaatgaccttttggattttgtccaagcacaaaattctggttaataatcacttggtactcggcgttagtactaggaaacttaaacagatatggattctatggaatatctcttttcaaggtgtaccaaattaagcctagatttaagatagtactattacttggacaatttagtatttattaggatttttatatcttgtcatcatcaatgatctaaaactattttttgcatacgcggacataactggcgctttttcaaatactgcacacaattactgaaaagaaatgattccattttttacaagaaaatgcaatctaaatagataaaagagacaaacgtatagggcctgaggaattgtttaaactgacagtagaaattatataccataccatctctattttatgacagccaagtgaataatcttgaattaaagaattaatgttgaatttatatttttatttatgatagtatttgattttagttttgctttgcaccctttatttgagtttattacaagggaaaaaatgcctcccattgcttagaccctatagagtttcctttccttgggatatagtagatggtcattaccataagcaacttgaatatctggaagctagagagactttctattacaaagaaatgttagcctcattctatgactataaagttcttgctatcttttctgtaatacaaatcttgcagtaaaggctcaactatttttgttaaatatatcttctgagatcaagcagattgaagtttaaaaccaaactcacatacaaaatgttttaaaaactgtgaaactcagtctatttttgtataaaatagaagtgtgaagaaactaagtgtactgtactagctttgcaattagaaattttattttcaacaatatggctttatgagttgcatttttatactcatatgtaaaatcaatgtgtaatatttattacagaaagtgaaaatagagaatcagtgcaataaaatattgataacagataaattcagattatagagtgtacagagaaccttgagaaagtaaagagacattgaagttgaatatggggttccttctctgaaaatattaacaatctaatgggaaagactaagactagcaaataaataactgatgaaaacataaaatatctagaactagaaataccatttgacccagccatcccattactgggtatatatccaaaggactataaatcatgctgctataaagacacatgcacacctatgtttattgcggcactattcacaatagcaaagacttggagccaacccaaatgcctaacaatgatagactggattaagaaaatgtggcacatatacaccatggaccactatgcagccataaaaaatgatgagttcatgtcctttgtagggacatggatgaaattggaaatcatcattctcagtaaactatcgcaaggacaaaaaaccaaacaccgcatgttctcactcataggtgggaattgaacagtgagaacacgtggacacaggaaggggaacatcacactctggggactgttgtggggtggggggaggggggagggatagcattaggagatatacctaatgctaaatgacgagttaatgggtgcagcacatcagcatggcacatgtatacgtatgtaactaacctgcacattgtgcacgtgtaccctaaaacttaaagtataataataataaaataaaataaaaagaaagcataaaatatgtaaagctagtagagttatctggtagaccattcaaaaccatttaggccttgtctcatgacatgcaaaataaacaaacttagttcataatgggaattaactcactgcctcttcaggctgtcaaaacacagctattaaagttacaagacagctattaaagttacagggattacagtctcaatctaatgaatgaatgaatgaatgcatgaatttatttattttccccaagatggagtctcactctgtcacccaggctggagtgcagtggcgcaatctcggctcactgcaaccttcacctcccaggttcaagcaattctcctgcctcagcctcccaagtagctgggattacaggggtgcgccaccatgctcggctaattttttgtgtgtttttagtagagacggagtttcaccatgttgaccaggttggtctcgaactcctgacctcatgatctgcctgcgtaggcctcccaaagtagtgggattacaggcatgagccaccatgcctggcccactctaaatgaattttctaatcgttgataaccttgacatttttacttcagtcttgaaattttgatttttttggtttgttaaagacccatatgaatgctgaaaaaacaattagcctttcttttgcctgtaccctcacgtctctatatgctaaaaaattattttacacactcattcaattattggggcgttagtttttcattgtgaagtaaaagactagagtagttggagctaactttagatgaccttgtgggagagaactggaatagaattttgtagaggaatattatgcaagatgtggaagaattggccgtgttcactgacagaagaacaaagtagttctcagccattttacaagcatgacttattttattttattttattttattttattttattttattttattttattttattttattttattttgcagaccccatgtgttaaaaaaaatttaaggcttttgaactacatttctataataataataatttccctaatttttaattaatgatgtgtaaccactagtcagcaggagacaaccagtgttaccaaagtcagtttgtgcaatatatggtttctcttgccctttttgaattacccatagtggttctcaggccacactcctccagagttatctctatatactatcctggaaaatatgagtaataatatcttcatcttttattttataatttggaaaaaattaaatgacagaaagaaatggagaataatgtaagaagcagacatggaccaacacttcaaattgataaatattaagatatggtcatatttgcatcagaacttttttataaagttgtttgtatttctgctcaggccccttcctcagaggcatgcatgagcattggcatgtatccttttggttgatatttatatactttgctatacatatatgcagaaacaatatattttacttctcaattttagtcaacaatgaaacatcatggagtttaaacagaaggatgtgggattatgataggataattaaagtggttcagaagtttgatatagtagtcatatcagaccctgcttgaaactccttgatggcttgctcattagcctcaggataaaactcatattatttaacagactttcaaggcaacacattattagatttccaaagttttccctcttcagttcatctctccatatttctctttcatatctcatgcccttgttgctctgtatgcctcagccataggaccttttaagtttttaaaattttcagtctctaaagctgtattagtccattcttgcataggtttaaagagctacctgagtctgggtaatttataaagaaaagaggtttaattgactcaaagttctgcaggctgtacaggaagcatggctgggagacctcaggaaactcacaatcatggcagaaggtgaaagggaagcaggcacatcttacatggccagagaaggacaaagagagagcaagggggaggtactacatacctttcaacaaccagatctcgtgagaactcactcactatcacaagaacagcaagggggaaacacacctccatgatttaatcacatcccaccaggcacctcctccaacactggggatcacaatttgacatgagttttgggtggggacacaagtccaaaccatatccaaagcctttccacatatttgttttgcccagtacaattcttccaactttagttcctctcatccttccaacctcaatttacacatcacttcctctgggaagttcctctgatccttccaaaatatgacaccagagcccaattaagacattttagaagcctcaaatactaaaagtcatataggttatatgactgttgccctaccaccatattattcacaataaacacaatattaagtgcaatgaagtctgaaatttcggtttcctaatagtgactattttgatgattttattctttgaggtattgagtatcatgttatttgacaaaatcaagttacttgtttgcttactgcacagcagtctgttcttaacccatcatggtgcttattaaataatcttattgtttttctgcacattttactagactgtaaacaatttgacggtaggaattatgtattgttcaacatcctatccccagaacaaggacaatgcctggaacatggatattgatcaataaatatttgttaaatgaaaaaatcaatgttaacctagtttctcatggtttacaattacttattcaaaagccttgccttctctaagtttattcttagagatgagcaattccgacctaaaaggacgtgaagatcaagttattcctgtgtgtcgcactcactgtataacagagtggatcttcagatgagggaaaacatgaatataaactatgtctaaaggtacatctgtttgtataatattttacaatttatgaagtattttcaaatataccatctcatttggtctttataatacacttgggaggcagatatttttgtctaagtttcagatataaggtagcaggctgggacaggttaaatgacctgcaaagttatgtggcagtaaggcaggactagaactcaagtccacatcttttgactctaaataacctctctatatggaaacctgtggatcagtttatctatggctatagagcaatatagttctttctgtcactgaaaattcctaacctgaatgcttattcatgatgatcaaagtaaagcaatagtgcaattagaatatatcttccaactgactggtaaatcaatggattttatatttcaaaggaaaaaaagtaatcttagtatttttctctcttacatatcttctagagcctttacaaacctgagagtgtctatatactcattcttactactttctgagtttttggcatcgataatgttctaggtttttatagtgagataaaagtgttaaagtattggatttgagtctcagaaaacatgaaaatccaactatttttattttattattaaacaaacatattaatgattttatgtgacatttttgcataaagcttctacagagtcttctttctatggtttcagtatgtaaccaataagtcatttttatgtaaagatgtttgctttacccaagagattgtaaatgaaacttttatacccaaagccattctgtaatgaagattaccttatgtaacagattgaatgaaagcaagtcagaaataaatctttgtagaaaaccttattgacaaaattctccctcattcttttttaatccccttaaatcatattgccaccagagagattgatgtcagtggcatatttgatcataacactcttctgcttataccccttcaggggtacccccttagtgtacaagataaattttaagttctttcaaaatggtcaagtaccagcctatttcatcagcctcatttcacttcttcttgctttacaattcatattctagtaagaacaaactatgtttagctccctgcataaatctggttctcagccctatgcctttttaatcatgctattccccttgtcttgactattcctcagcttttatctggataactcctgtttattcctccagattctactcatgcttctctttaaaataaatgcctttctcagactgcttacctaggtggtagtctttccttccttaacaccctctactcatgtctttctttacagctactaatttatatttttccagctctattgaggtgtgattgacacattaaaattgtacatatttaagacatacaacatgatgctttgatgtatgtacacattatgaaataattaccacaaacaagctaattaacatattcatcacctcacatagtttcctgtgtatgtgtgtgtgtctctgtgaggtaagagcacttgaaatctactctcttagcaaatgtcaagcatgcaatacattattattgactactgtcaccatgctgtacattaggtctccagaactattcatcttatgactgaaagtttgtgccctttgaccattatctcctcccaccctgtccattgtaaccaccattctactctctgttactgtgagtttgacttcgttttttagatttcatatataaatgagatcacacagtatttgtctttctatgtctggcttatttcatttagcatgatgtcctcttggttcatccatgttgttgcaagtgggagaatatccttctttttaaaggaagattaatatttcattgtgtgtgtgtatgtgtgtatcacattttctgtatccattcatcttatgtagtacacttagattgtttctatatcttggctactgtgagtaatgctgcaatgggaaaccagacatcttttcaatatagtgattttatttcccttggatatatactcagaagtgggattgctggataatatagtcgttctatttttaatttttttgagaaacctccatactgttttccatagtgactgtaccaatttacgtttccaccaacagcagacaagaattctcttctctacgtttttgccattacttcttatcttttgacattttgattatagccattctaacaggagtgagatgatatctcattgtggttttgctttgcatttttctgataattagcaattttgaacattttttcatatacctaatggccatttgtatgttgtttttgggaaaatatctagtcaggtcctttgcccagtttttaatcaggttatttgtttctatttttgctgttgagttgtgtgggttccttacatattttggatattaaccccttattggatacatggtttgcaaatattttctcccattctgtaggttgccttttcattttgttgattctttcttttgctgtgcagaaactttttgggttgatgtagtcctgcttgtttatttttgcttttattgcctgtgactacaaatttatattgtactatatacacatttttgcgatttttctttcctgctaccctttgagctctttgcatcttctttccttgggaattttatttcggtatttttctacccttgtatcttttggatggtctgtgcatatttttctctagaccactaagtaaaataacatataacttggcataatctattggtaagaagtcaataatcaataaacaccatgccaagaatagaacatttcattattcttttgtagttaggtaagacgcattgatattttttgttaaacatcattgtatgatacatcatgatattgattaatgtattttagcgattcaagcacataacgcatttcaaaggtaatgataatctgtaaatgtgtgcagatacaagtataccagtgtatgtggtaggtggaaaattactacagttgtgggtatggagacactgcaagtacagaattatggaatcagggccttgttcacttggaaggaaacttaggagtcatcttaattcagctgcttttgaaatttgtgtgtggatcatgataataacagctaacatttgcatgttttgtaatttacaaaacatttccatatcacttgatgttcataggcagttcaacagagttgttattgttatgatgctcttgacaactctacaaagagaattggtttcattgtactgtgctgctattgtagatttcataatagactggaatctgctgtttgctgaaggaataagaagggatacatcttgttagtacaactgaatccctccatgttttcttccagatgtggcctttactgttatttgtttggaatttttgttaaatggcttcctgttttgtaactgttgggtggactgtagtatatttctctagacctgcactgcatctaacaccacagtaaccactagctgcatttggatattgaaatgtaaatttaaatcaattaaaattaagtaaattcgattcctcatttgcatgagccacatttcaagtgctcaataaccacgtgtttctaatggttatcaaattgaacagaatagacaaagaacatttttgttatcccagaaagttttattggacagtgctactctagaccattgctatatgtatgcatcttgatgaagttgtcatctgtcagtagttaagctgggatgctgtaaggcagaaatctgtaaaagtaatcagactgacaataagtggtaaatggatgaggattgttctagcttattactaaaaatggaatagtccctctcccctatggaaaagttgttagaaacttttttgaatgtaaaagactgtaaaatgacttaaaactagtgaaaaactgaagttttgctttcttttttaacttttaagatcagaggtacaagttaacatttgtcacatagtgtatgtgtcatgggggtttgttgtatagattatttcgtcacccgggtattaagcctagtacccattagttattttttctttttctctccctcttcccaccctccaccttccaataggccccagtttctgttattcccctctatgtgtccatgtgttctcatcatttagctcccacttaaagtaaaaacatgtggtatttggttttctgttcctgtgttagttttctttttacaaaataaattttgcttttgttgttcttcagctcattgtggccaatactatatcacagtatctttttcctctgaggaataagcagctcatgtcaacattttctactcctgacaatattcttcatcctttttttttttttttttttttgagacggaattttgctgttgtccaccaggctggagtgcagtgtcacaatctcagctcactgcaatgcccgcctcctgggttcaagtgattctcctgcctcagcctcccaagtagctgggattacaggtgtgcactaccaccacccggctactttttgtatttttggtagagacagggtttcaccatgttggccaagctggtctcgaacttctgacctcaagtgattcacccgcctcggcctcccagagtgctgggattacaggcgtgagccaccaagccaggctatccttaagcttcaccagatttgtgcctccttgcccctggttgataaatttgccacatttgttatactgttttaagaagatggaaagtattagatatattcttgattcatttatttttccctttaatatcacacttcagtcagctagtctcctttcttcatatttgtcatgtcaactcctccaatgatgcgttctgcttggtgtgtatatagtactagatcttccatctcctaatacactctcccaacaaaaatgacaagaatcatgttatatagagcatacttatatattctttgcatttataatctttacatcagctgagttatataaatatgtttatctggatttttgtaaattactgtatcatgataaatgctaaactgcctatcttctttttttcatcactttgaccctgcttctcaaaaaactatgcttatagttcctttcctactttgaaatatttcttagaagaccagtttatataagtactcttacttgtacatctaaactcctcacattgtctttttcaactactccatctccattattaaattaaaactgatttttaaagcttcttgctgtcatttttctctgactcttacttaaattagacactgtttttcccttctccctttccaaaactcttttcttgtctctgtaatatcactttcttcatttaatcctggccatgggattaattcttgctctggctcctaaacaagcattgtctgaggttttatcctcagccgtcttcccaccatacatactctgttctggtgaagtcatcattgttgttttcttgtagctttaactatcccttcaatgtcagtatcttcaagatctggctctgtttccattctaattcagttttatcaaatgcttgccagacaattgtatgtaacacgttctgttttcagccgcttctaattttatgtgcacaaaataaaattgttttaatctcctcgatttcctttctccatctctactataccattcatccatccatttcctcaggcttgaacacttagagtaatgtttaacttttccttctccattatttcttgtttattaatttgcatatttcaaattttttgtggatacgtagtaagcatatatattatggaatacatgagatgtttgatgcaggcatgcaatgtattcataatcacatcatggaaaatgaggtatgcatcccctcaagaatttatctttcatgctataatccaattatactttttaagttatttttaagtgtacaattaaattattattgactatagtcacactgttgtgctatcaaatactagatcttattaattgtttctaactgtatattttttgtacccatccccacttctcctccacccccactgctatatttcccagcctctggtaaccatctttctactctctatcttcataggctcaattattttgatttttagatcctgcaaatgagtgagaacctgcagtgcttgtctttaggtgcctggcctgtttcacttaacataatgatctctagatccatagatgctgttgcaaatgactgaatctcatttttaatggctgaatagtactccattgtactacattttctttatccatttatctgttggtagacacaggttgcttcaaaatcttggctattgtgaacagagctgcaaaaaacatgaaagtgcagatatctttttaatatcctgatttcctttccttgggtatatacccagaagttggattgctggattatgtcacagctgtatttttagttttttaaggaacctccaaactgtactccatcgtgattgtactaatatacattcccaccaacagcgtacaaggttcccttttctccacatcctcaccagcatttgttattgtctgtcttttggatataagccattttaactggggtgagatgctatgtcattttagttttgctttacatttttttgatgatcaatgatgttgaatacctttgcatatgcctgatggccatttgtatgtcttcttttgaaaactgtctattcaaatcttttgcccattttttaatcagattattagatttttttttctatagcattgtttgagctccttacagattctggttattaattgcttgtcagatgggtagtttgcaaatattttctcccatgttgtggcttgtctcttcactttgttgattgtttcctttgctgtacagaagctttttaacttgatgtgatcccatttgtccatttttgctttggttgcatgtgattgtggggtaatactcaagaaatctttcccaagaccaatgtcatggagagtttccacaatgtttcctggcagtagtttcataggttgaggtcttagatttaagtctttaatccatttttatttgaattttgtatatggcgggagatacaggtctagtttcattctaatgcccatggatatccagttttcccagcaccatttattagagagactgtactttctgcagtgtatatccttggcacctttgttgaaaatgagttcactgtaggtgtgtggatttgtttctgggttgtctgctctgtttttactggactctgtgtctgtttttatgccagtaccatgctgttttaaatactctatctcagtagtataatttcaagtcaggtgttgtgattcctccagttgtgttctttttgcttaggatagctttggctattcttttgtggttccgtatacattttaggattttttttctattttttctatttctgtgaagaatgtcattggtattttgatagggattgcattgaatctgtagattgcttaggtagtgtggacattttcagaatattgattaatccaagaacaagcaatatcttttcattttttggtggcttcttccatttcttttatcagtgttttgtagtttccattacagagatctttcacttctttgattatgttaatttctagatatttaattttatttgtggctattgaaaatgggattatttttgttttctttttcaaatttttcaccgttggtatgtagaaatgctactgatttttgtatgttgattttatatcctgtatgtttgactaaacttgatcatcaattctaatagttttttcttggagtctttagatttttcccaatttaagatcattatcatctgcaagcagtggtaatttgacttcttccttcccaatttggatacactttatttatttctgttgcctaattgctctggctaggacttccagtactatgttgaatagcagtggtgaaagtgggcatccttgtgttctagatcatagaagaaaggctttcagttcttcccgattatgatattagctgtgagtctatcatacatggcttttattatgttgaggtatctttcttctatacccagtatttttttttttttttttgagacagactctcactctgtcgcccaggttggagtacggtgacgtgatctcagctcactgcaacctctgcctcctgggttcaagtgattctcctgcctcaccctcccaagtagctgggactacaggggcgtgccaccacacccggctaattttttagtagagatggggtttcactggtgttagccaggatggtctcgatctcctgaccttgtgatccgcccgcctcggcctcccaaagtgctgagattacaggcatgagccaccgagtccggctctatacccagtcttttgagggtttttattatgaagggatgttgaattgtatcaaattctttttcagcatcaattgaaatgatcctttgatttttgcccatcattcttttggtatgatgtatcacactgactgatttttgtatgttgaaccatccttgcaacccaggaataaatgacacttggtcatgatgaatgaccttattaatatattgtggaatttggtttgctagtattttgttgaggatttttacatcagtattcatcagatattggcctgtagttttctttctttggtgtgtctttgtctggttttggtaccagggtaatattggccttgtagaataagtttgagtgctccctcccctgccccctctattttttggcatagattgagtaggattggtatttgttctttaatgtttggtagaattcagcagtgaagccattatgtccccagctttcctttttgggagactttttattatggcttcgatctcattgcttgttattggcctcctcaggttttagatttcttcatggttaaattttggcaggttgtgtgtgtctaggaatttatctatgattttccaatttattgccatggatggatatcgctgctgctagttattcagggcccaagagcttttcagttagcaggtgatgcatgctacctggactgggtccttccccttaaggcaacaggttcccttttgacccagagtgcatctagaaatgtctatcaggagctagggcctggaaagggggcctgaggactctgactggtaccctatcctgctgtggctgagctggtatcccaagacgcaaacaaagtcttccccactcttccatttcctctccccaagtgaaaggaaggggccttctttggagccacgagctatgcaacctggggttaggggagggttgatgccggtgctcccttagccatcccagctggtatctcagtaagttgtgtgccgcccccctagtccactgtctctgggcccagcttagcactaggacttgcctaagagttgctgtccttgtggcctagacggcttttgcagtttatttggggccccacatcgctgtagcccatggtggcgaagcttgtggaaactcaagttcagatggctgggattggtgattgattcccctctggttaggactcgtttaaatgctccctccatgggtgaacatcagctgaatttggttcagttttgttttctgctataacaacgtcagagctgagtttaatgcctcagaattactggctttctttctccccagtgcacagaaacactctcatcatcaggcagctgctgcccaggtttgggggaaagggggcattggcaattgaagactgtttttcctacctcttctgtgcctctttcaatgatatgaagttaaaactaggtattgtgagtactcacctgatttttggttcttatggagatgtttttttctgtggagatagttgttaaatcggctggggggacaatccctcctccaccctttctagagataaaacatccactttagtatgtctaggaagatacacaactttgcggagattcccataactgagatatggcacaaaaattactcttaaggggctatgaagaatggaacaagagatgactatgggagttgttagctggacaagaacatttcatctctacagacccctcaaccctcactcacaactcacattgctgtatatcatcaactattatattagataggctgccttgacttcaactcttccccaaggaaagtcaagagaaattataaactgactgagttaagtttttgaaagagattcaaaatggaaattaaattgttatagaaaaattgaaattgcttttcttttaaaacaaaaacaaaaattttcttcaacctaacattggtagctctccataatatgccccatattattttctctgccttctttcccactgcattttccccacatagcttaaattttaaccaaatcagtctgcttacttcttattgactgtgcatttgttcagtgtgttcacacactttgaaatgttctttctccctaaaccttcaaattccagatttgaaagccatttagggccaggtaaaatatcatttccttcacttagttaatccaggattatcagaatttatctcctttttaatgggatcttttgttagaatttatcttatctaccttctatttgtatttgaatgttttctcccctcctacttaatgaaattgtgatggccaaataccaagggtaatttatccctcattacataatagtatctggaactgaattgcatttagatgacaaaaaacatgttggtgaactgaattgtgacttcaataaataaatgaatgcaaggaagagaggaaggcagggagggaggagaaaaaaaaggaaaggaaaagtataatattcattgcttaaattaaccccttaggcatgtaaagacattttgataataatagaatatgttgaagtgttgagtatgaaggtaccattatcaaaggtttacatagatggattatttatatattacttctaagtaaaacaatatttttatattatttgtaaaagtatacaatatatacacaaaaataagacatatggaaatttatggcatttataaagttccatgaaatataatagtattattattagagatatacactatttcccttcactatctctctttatatatttactattaataacatatgcactgttcttatgattataatatacaattgatgagaaatattacttgttctgagcattgtgacccaccaggcgcttaaaacttgttgacaaagtatggagcatcagtggtaatatgtaggagtaaaaattgttctgttattctgctcagtatagcaattgcatcattgtttcacagaaaggataacattatgatcctgtgtgggtgtatagctcatctgtgggaggatgtttctgtgcatacttagtgatcaaaattcaagaaacacgcctcatttttatgaatattttctcattaggaatttggctcatgtaaatgcatcacataatttgtagaagcattatatggaaaaggaaaaagaagaaatgaattttttttgcatatacaataaaagcttgagctactgaagagaattcctggtagtatatagtatcgtgactggaaacccagtctttaaaaactaaatttaattctaacctaaaaataactggaatgtcagaggtgtacctttccacagcatgaataggtttgtaaagtatagatttatccatatgcaatgctattttctctttaaaacttgagatatcttttgggaaaggatttggccccaagtattaataaaacccatactttagaagcaagtattttaaaatcacctgttgatggaagtaaaataacttagtaataaataaacccccccaaagtacctagagctatttaaatacttaacatgatgaaatgaatgccataaaattacagcttaacaaaatataacatagtcatttagtttctattcttctccctaatataaagtagcaggttaatatgcattctctctgtttggttttgttgttcttttttttgttttgaggcagagtctcactctgtcacccaggctggagtgcagtggtgcaatcttggctcactgcaacctctacctcccagattcaagcgattctcctacctcagccttccgagtagctgggattacaggcatgtgccaccacacccagctaatttttgtatttttagtagagacggggtttcaccatgttggccaggctggtcttgaactcctgtcctcaagcgatccgcccacctaggcctcccaaagtgctaggattataggcatgaaccactgtgcctggcttctatttttaatatgctgcatcctcaccctttgtggaaagcctctgggtttcaataactagcaagccgatcttgctgaaagaaggtagagatacaaacaagtagaagcaactgttccacataaagaaagaaataagtttaatgggaaaaaataatgaattgggggaacgtgcaatcaaaatacaattctgaggatctcagaactatttggagtgagctggcagataatgttataaaaagcaggttaccagtttatggattctatatatttgataattttgggatagctttggtgttcctgtatcacatggtaatcctataaaatagatcaagtgtttctcgaaataccatctttataaatatcatcttggaggcctcactctgaatcaactagatccgtacttctgggaatctgcattttaacccacccctcaaatgattcttatatatgcagaagtaaaatctgaaaattactatagtagcttaactgagtgtggttacattgcttttgtgatgatgccattattttctctttctaaagacccactgtttccaagacccagttaaaagccacctttcttgatttgttttaacacagagtttagtttcttcctcctctgctcctctagctcccataattgtgcctttgttacactaatcaagagtatcccaaatctcttaatgcagatttaaactttaataactttacatacgtaagtgctacaaccttaccaaaaacattatttaaaatttatttaaatttattttacaatcatttagttttgtttattttaaatagtaagttcttaattttaatatttatatgtggcatttttttggactggtagaaaaacttgaccacctcaatcacctcatatatctcccttaaactttcttttgcagggtcatgtcaaaatagttgagtgtgcaccaatattttattcttcaaataatcttaaatctaggatcacagatgtcatcctttctgtcactaacccacagctggtagaagtttttgaaaagtttgaaatttgactagagcaatgtatagtacaacccagtatactatatgttgaattttatttcctgttgaatgttaataaaaatatattaatatcttaaaattttaaataattggccttttatctattgatttgtgtaatggtgtatcatttatacttctaaagttaaaaatacttaaaacagcatgaatactttgaaattctgtgttttaacttatttgtgtgaattcctatctccctaaacagcacttctctaagtcaggggccatgttttattcatccttttgtctctagtacagttgattaatatttgctgaatcaaggggaaaaatatgtctattttatattgtctaattaatttagtatattcaatattatttaaatattactaactatatttagatataggtagcacatttaaaatgtaatattaatatagcatcaaacatatatttaatagtatttgttgtgtttccatccattgcagttattatccttttagatgctcaaattgttccatgtttgactagggggaatctcttcatgttgagtcctgagtcctactaaaacaggagccaactcctgtgtagtggtagtcttgacagattactcctagtagtctttgataacttccttctgtcttgtatcacagtataatccaagctcatcttgtacgtttcctattccagatctcaaatcagccattttccaagaaggcttggaaatgtggttttaagaccataaagtctgggaagtgtatcattactaggttggtcattgttcctatgccttttcagggtgcagtgctaataaatacatgcatacatgtatatacatatgtacatagataatacttcaagagactccagcatattatttaacttcttcaatcttatatatgtgtctgctttatcccatgctaaaaatacttatcaatgacactggagtgatagaatggcagtcacataattgttcagttattcatcttataaagcacacacagcagattctgcatgacaataataatcacaacactaccatctaacatcatatgattactgaaaacagtttaagattattttaacagttctttttgttggatcacattaggaatgtgctagtaaatttttatattttaaagatacttgaaatagttactttccgtatgattattatccactactagagtatacattcagatcatgtttactttgtttacttttttccttgaggagaatccctttgaagtttgaatttttagtcataccctctgattctgggaaggtaggcaaataatggaatttgcatacattgcagctgaagcaagctgtagaagcagcatgtggaagctgggcaagttcccaacttttcccagattatctctcctttggcatatgagtccctcagaaagacaagacccaattcttaagtatttctgtgaattttgtaaaatatacttaagttttatttttaaaactttgccccgatctgcatatgtatttcttctgacaaggcattgtggtgaagttgcattatcaaaaattgtgttgaacaacattccttttttgttaaaattaaattcaggaaaaaatgaaatggagtatcatttcttaaaatattcagtactgtggaaatgggtttgttttttttttcaaaattatccaaataataattaattttattttttgaagtaaagttagttttttaaagttaaaatagcaatggccaggcgcagtggctcacgcctgtaatcccagcactttgatctgccgaggcgggcagatcatctgaggttgggagtttgagaccagcctgaccaacatggagaaaccccatctctactaaaaatatgaaaaattagccgggcatggtggcacatgcctgtaatcccagctactagggaggctgaggcaggagaatcacttgaacccagggggtggaggttgcagtgagccgagatcacaccactgcactccagcctgggcaacaagagcaaaactgtctcaaaaaaagtaaataaataaaatagtgacattaatacatggttaaaatgtatttatcacttaatgtatgtcagattctaatgacttatctcattttgtcacttaattctcacagcatttttattgggttgctaccagtatgcccgttttataaattttgtgaggaaactgcgccatagaaacattgtctctaagcaaagatcagtttgttgtattactgcttattgtatatcaagtaattgcaggttaaaagaaaagaccatggtggtttttgaaagaattttttgtaatttctgggacttaaatttaggtgagaactatgaacttggtaattattattagtagatgtattaattttaagtgtgtactgtaaagtatatttaatagcttgcaatagttgaaaatataaaagtatttgagattttgataggactattgaaataaatgttagtgtgttttttaatgttctaatctataataaattagtatttgaaatgttagggacatttcaacagaatacatttatcacgtgtaaaagcttagatagaaaatggttacaatattttttcaatatttgtttttaaaagtctacttaatgtatattgtcctttagtatgtgtttaaaagaagtaaagttagaatatacagttaagcaaaaataaggatagcctctgttactgaccatcagagctaaccattattaatattttggtatgtagcatcctagatttttcctgttattattgcttttacttgaattgttaagacttttaaaattatagtataatttctaagaaaatatttttaaaagaatgcttgatattttgaatctaatgtatatggttcttttttttcaggattgtactgtatatgaaacagagaataaaattcttcacgtggtgagtatacttggatttattttaatctttattagaggatatttccttgttcaactagaagaggtgaacca

SEQ ID NO: 5537 - DNA, 218868 bp, human; identical to SEQ ID NO: 3294

SEQ ID NO: 5538 - DNA, 215284 bp, human; identical to SEQ ID NO: 3295

SEQ ID NO: 5539 - DNA, 210242 bp, human; identical to SEQ ID NO: 3298

SEQ ID NO: 5540 - DNA, 150387 bp, human; identical to SEQ ID NO: 4423

SEQ ID NO: 5541 - DNA, 674804 bp, human; identical to SEQ ID NO: 4424

SEQ ID NO: 5542 - DNA, 23255 bp, human
gtattgcctgcacaaatatctaccaggtctgcgacgaatagctccagcaacttcgcaccgtgttttccactcagcctaccgacaggcactgtgcagattcaagcggagagatgtccaagcagtgaggccgctgctgcaccggccatcctgagcccctactcggccttcccgtctccgcttccccgccccgcactaggacccctgcagatgatcaggcggcagccggggtgatttccttcctcttttggcaacatggcgggcggagaagctggagtgactctagggcagccgcatctttcgcgtcaggatctcaccaccttggtgaggttttgcttggggaggatgcagagtgagctcaggagtggaggtgaccgagcctcccggtggtattgggactagtcagtgtcgggagcatgggtcaggagcctgggtcaggagggagacctggaactgggcgccctaagccatgctcgcgccgcctgtacccaggccagtccacgatctgggcgcaggcgtgtacggtcgtgggacttctagcttctggagggttcggctggaaagtcttgatgttgattgtcatggtttcagcctctgaacgtctgggaagggggtgtcctgtctgcattacttttagtgctaatgttcccaagattggggggatctctgacttccagatatcccctaatagttgagtggaggtgtagtctgttgtgtaatgatgaagggctcttaacagcttcccagccataggagtacaaagttactgatagggaaaaggagctttagaagtagtggaaagctgtgcagatggtggcaagatgtagatagcaaacgtaaagtcaaaggaaaagttctcatttgttttacgtgcagtgttttaaaatatatttcattgcaggatgttaccaagttgacgccactttcacacgaagttatcagcagacaagccacaattaacataggtaagagtaacttaagagacctaaccttggtctccaacaattaattttaacctcactttttgtgtgattacttgaatagtatgaggattcagatattcaagaaatagatactgagtccttgtgaataaagcatctgctacatttgcggtgcagggggagcacaaagaatgctgcccacatgtagcttacagactcggtaagaagaaaaaatggagacataagaaaagtttaatagcataaggcagtatgtagtcatatgtagcagaagtttaaggaagaggtgaaaaatgtggctgtacttgacacacaggattatttcaagggcagaatttatgaaagttttatttgatgtacaagctgtgattaaatagaaggttttttttcttaattggcacctagaactttagaggagaagttacgttgactgagtgtaaattttggacattttgagtttgtacaaacagcacagtttgtacgaaagtaagttaaaaagtacagaagtaagttaaaaagtaagactagtttttaacctagttaaaaagtaagactccaccatgaggctattaaagttacagtattacagtctggagctttaatttattaatgcaaacaaagcccaaataagcctacaggccttgaactactgcccctgcattaaaaattttggttgaggtgaccttggagcataacctaacctccgaacaacctatgctaagactataccagttaaagcaaattactgtgcatatattgacccaataatttgatcaacggaacaagttgcaattaaacttaggttgtttccttgtttgttcacagatccctttttgttgtgtcagggcccatcatacctgtttaatctggaaatgctggaaggttccttaatatataaagttctggccgggtgcagtggcttatgcttgtaatcccagccctttgggaggccaaggcaggtggattgcttgagcccaggagttggagaccacctgggcaacgtggccaaaccccatctctacaaaaaatacaaaaaattagctgtgcgtggtggtgcatgcctgcagtcccagctactaaggaggccgaggtcggaggattgctcaagcccaggtggttgaggttgcagtgagctgtgatcagggcattgcattccagcctgggcagcagcaggagaccctgtctgtcccagagtatattttttaagtaaagctgttagttacatggaagtttctcttaagtcctatatgagaacacgtttctagtaggaaggggtatggaggaggaaaaattgaagtcactgttggttttatgttgatatttacagcaagttatggctttggctttaattgtatttatttatttatttatttatttgcgacggagtctcgctctgttgccaggctggagtgcagtggcacgatctcggctcactgcagcctccacctcctgggttcaagtgattcttttgcctcagcctccccagtagctgggactacaggcatgcgccaccacgcccagctaatttttgtatttttagtagagatggggtttcaccatgttggccaggatggtcttgctctcttgaccttgtgatccacccacctcggcctcccaaagtgctgggattactggcgtgagccaccgtgtccagctggctttgggttttctactcttaacactatttgaaaaaatatttggtatgtaattaaatacacatgaattaattttttgaactttgtccataggtacaattggtcatgtagctcatgggaaatccacagtcgtcaaagctatttctggagttcatactgtcaggttcaaaaatgaactagaaagaaatattacaatcaagcttggatatgctaatgctaaggtaagctgtgtactgtggaacgagaaactaactttaattgttgtgcagataacaaatcaaaatctttttttattgaaattttagatttataagcttgatgacccaagttgccctcggccagaatgttatagatcttgtgggagcagtacacctgacgagtttcctacggacattccagggaccaaagggaacttcaaattagtcaggtgacctctcttttgctacaaacactacactttatattttattgtcttctgttttgtgctttttgaaatatcgaggtgttaaacggtgaacctaatggctaaatggttttgttgtttttccattgtttatgtttttatgggaaatctgaaaagtcaagcatctaaacctaagttaaaatacttacatgcaatttctccaaactaaaagtatcacttaaacaaaacagaaaaacaactcattggattgaagggattctttttctaggcttcctgaatttcttttaaacagcgctgtttctgtatgttaaataggagagaaacagagccatttctaattacttctctaaaacacttgaacttgttccccatctgttttctgaatatgattgcatacctgtttttttatcaggatactgacacctgtctagtgatgtttatggggattggagatgccctacaaggaatgtttagattggggcagggctgggaccagggagggacaagtgaggccttcacctcaagcccaaaatgtaagtgggcctggcggtggcaggtatgccagaaaactcagtaattaggataaatattttaatgcagtgttttttttaaattaatgcaaaaaatgtgataaatcagaattttaaataagggcagactctattactaaatttttttccccttttgctttggctcagcatggcattgtattttgtttatgattgattttttgcattaatttcgactttttaaaaatactgaatgcatatatttttttttctttcttttttttttttttttttttgagacagtctctgttgcccaggttggagtgcagtggtgcgatcttggctcactgcagcttccacttctgggttcaagcaattctcctgcctcagcctcccgagtagctgggattacaggcgtgagcccccatgcccagctagtttttatttttatttatttatttatttatttttgagacggagtctttctgtgtcgccagactggagtgcagtggtagagacggggttttaccatgttggccaggatggtctcgatctcttgaccttgtgatccgtccgcctcggcctcccaaagtgctgggattacaggcgtgagccactgtgcccggcctagtttttatatttttagtagaggtgggcttttgccatgttgtataggctggtctcgaactcctggcctcaagtgatctgcccgcctcagcctcccaaagtgctgggattacaggcatgagcctccatgcccggccattttccttgattactgagttttttggcagtctcttaaattttgcacttgtctcactgtagtcctggcctttaataggggatcagcaaactttttccacaaagggctaggtagtaaatattttcagctttgcaagccatagagtttctgttgattctgttcttctattacagaagcaaacgtagacaatacgtgtgtaaataggtatggtggtgggccagatttggcctaagggctgacctctgttttagatcatgacaatgtgagcatgcgattaaaaaaacaattgtgactctgaatgaataccatagttttgttaaaagtgctgccatctctgcttcaaatgggcaattctagtttttcaaggtgttagaggtatttttggaaaattgtttttttttttctcttttttttttgagacggagtttcactcttgttgcccaggctggaatgccatggtgctatcttggcgcattgcaacctccacctcctgggttcaagcgattctcctgcctcagcctcccaagtagctgggattacaggcatgcaccagctacatgtggctaattttgtatttttattagagaccgggtttcaccacgttggtcaggctggtctcaaactcctgacctcaggtgatccacctgccttggcctcccaaagtgctgggattacaggtgtgagccattgcgcccagccagaaaattgttttttcaaattctcattctgttaacgtggtttttataagtcattataagttttagctttcaaatcaatgacattctcagtatatactctccaccattattctataccatattcattttcattggattttggagtttatcttccattctgcacataactaatttaatttgctttgtaatctgcagtggttttcatcagctggtgaacttatttccaagttctagaaacgacaagccctgtaaccattttatagcaataagattatttcctaagttgatttaactttaaaaaatctaaaactagcatgtgtaagtagtgatttatgttaaggctgattgttatttctcaatcattagacatgtttcctttgttgactgtcctggccacgatattttgatggctactatgctgaacggtgcagcagtgatggatgcagctcttctgttgataggtaaatacctcacaattggtttggacaaatcaatgtggaacaaatccaagatgaaatatttaaaggggaactaaggcctttaaggatcatatctattacctaagggtgacatgaatgggaactaacatgtcatccaggatgactttcctacctatcagctatcacaaaatactcaaaaagatagacttggggctgatagcttgcgagaattcttgtggtagcatttgagaaaaagaaaaaaagtcaatagttcatttttctcatttaaatcacatgaggtgatttatttagttttaaatgtatgtgtaaaactatttgtgttatggtttgtgtgtgtgtatgtctgaactgtctactgtggaagtatttaagatacaaatattcataatacgtgctgaagtgtaggaataagtggagttttgaagggtagcgtatgctttgtttcttatgttagctgttgagagatttcattactagggggtaaaattttttaaaagctgctggtgcggtggctcacgcctgtaatcctagcactttgggaggctgaggtcggcggatcacctgaggtcaggagtttgagaccagcctgaccaacatggagaaaccccctctctactaaaaatacaaaattagccgggtgtggtggcgcatgcttgtaatcccatctactcaggagaatctcttgaacccgggaggcagaggttgcagtgagccaagattgcgccattgcactccagtctgggtaacaagagtaaaactacatctcaaaaaaaaaaaaaaaaaaaaaaagcgactgggcatggtggctcatggctgtaatcccagcactttgggaggccgaggcaggcggatcacttgaggtcaggagttcaagaccagcctggccaacagggcgaaaccctgtctctgctaaaactacaaaaaattagccaggcttggtggtgcgtgcctgtaatcccagctacttgggaggctgaggcacgagaatcgcttgaacccaggagacagaggttgcagtgagcagagatcgagccattgcactccagcctgggcgacagaaggagactcagtcttaaaaaaaaaaaaaaaaaaagctgggtgcggtggctcacacctgtaatccctgcactttgggaggccaaggcaggtggatcacttgaggtgtcaggagtttgagaccagtctggccaacatggtgaaaccctgcctctattaaaaatacgaaaattagccgggtgtggtggggcacacctgtaatcacagctactcaggaggctgaggcaggagaatcgcttgaacttgggaggcggaggttgcagtgagccgaggtgacgccactgcactccagcctgggtgacagagacagagtgagactcagtctcaaaaaaaaaattttttttttaaagcatgccatgttggtatagtcaggacacttgaatatcacgacttgaggaggttgatcattagagtgctcaacaaaacatgcctatttctttataatacactgttggttatcttcacaatagcattcttccctccctcagttgaagagtagcctctgatattagtaaaaattcatagacagtattaagtgcttttcccttttaattactctctacttctcaggagcttgcctgggccagaacatttctaaaactggagagagttagagggctatacctcatacctgagcaaaagctgagtgcagaccctgagaaaagccaaacttgctgattttaagcttcttgcttaggaccaggattgggagccacacaattgggaggttccagtgaatgcaggcaacagaggatgaagcagggccaaaaggtggatacctggcaataatatcttccttattagggttagaacattcagaagtctcctttattagatgccaactttttttggggcggggagtgggtggcaaaagagactcataaaatgtaccattttatgtatttacagggtagaatttagtggcattaagcacattgacaattttctacaacatagtggttgtcatttcaccactatctagttccagaacttttgtatcagaacttttgtatcaccgcaaaaggaaaccccatgcccatgaagcgtcagtccacatgttttcctcccccagccccttgcaacccataatttgctttgtctctttatggatttgcccgcctattctggatatttccagctattcttatatgcatcttttttattcttcatcaactagctggtaatgaatcttgccctcagcctcagacatcggaacacctggctgctatagagatcatgaaactgaagcatattttgattctacaaaataaaattgatttggtaaaagaaagtcaggctaaagaacaatacgagcagatccttgcatttgtccaaggtaagaagccataatatgaaataaatctatgaatcactttgagaggcatttactctggataccagatgttaaattaacttttaatatattatctaaaacaaggtaaacttacaagtcttaagccttatcgccctaccttttgcttgttagtaacctgatataactaatgaaacctgtgattctgaatttaatatactaaagtatatttttgctggcagcaagttagaactgaggttgttttctggaaactttatcaatcagattaaaaaaaatctcagtgacagtaaaatgaataaaataattttaaaaaaccttgtcttacagtatttgttactgaacagctttcagatttggaagtgacagtgattatttaatctctagagtgtcggccgggcatggtggctcacacctgtaatcccagcactttgggaggctgaggcaggtggatcatctgaggtcggaagttcgagaccagcctgaccaacacggagaaaccccatctctactaaaaatacaaaattagcagggtgtggtggcacatgcctgtaatcccagctacttgggaggctgaggcaggagaatcgcttgaacttggggggcggaggttgcggtgagccgagatcacgccattgcactccagcctgggcaacaagagcgaaactccatctcaaataaataaataataaatctctagagtgtcccttctctaatagcataatgtttttcatttcagaggagatgtgatttattgttgacattttctctctcagtcttgtttttctttttagaaaggttaatttcttatgaactcagttctgtcatcacgagaagtaataagtgaatttgattaaagtctaattgtgtttggtctatttctttgactagcttgtttgacgtataatcaatacgtagcaaatatatatggttgggcgtggtagctcacacttgtaataccaagactttaggaggctgaggcgggtgggtcacttgagtccaggggttcaagaccaacctgggccacgtggtaaaactctgtcaatacaaaaaattagctgggcttggtggcacacacctgtgttcccagctattatgtaggaggctgaagtgggaggatcgcttgggcctgggaagtggaggttgcaacaagccgtgattatgccactgcagtctagcctgggtgacaaagcgagaccctatctccaaaaaaaaaaagtatatatgccagcagtctttgattagcagagtctgtaattttatcttgacatttattgggagattaattacatgttgttagaaattttttcaactagtagagtgctctttcacaggaatgttagtattttctttatttaaataagtttatcattgtactaatattaagtatgtctactaatataatgtaacaaattttctcttacagggatttgtattcattttcaggagtaaaaacaaacaatattgccatctttctaaacagaattatccactttccacttgttgctgacatttatatggggtttaggcatctattttattatagtaatcttaattgttttatgtaacagatacatagaataaattttataaaactgtataattttgatctttctaaattttgtcatataggtacagtagcagagggagctcccattattccaatttcagctcagctgaaatacaatattgaagttgtttgtgagtacatagtaaagaaaattccagtacccccaagagactttacttcagagccccggcttattggtaagtgataggatttgcctttaactcttaatctgatcttttccacattggtgattcctcttcaaggatgtttattaatatttcctctttctgcagaggtgataattcatacaatttttttgaaatcaattctgagattgtattggcagtgctagattgtattactgaatgagggacagagtcctgaacacagtaagaactgttaacctaagccgggcgcagtggctcacgcctataatcccaatactttggggggccgaggtgggtggatcacctgagttcaggagtttgagaccagcctgatcagcatggtgaaaccctgtctctactaaacatataaaaaattaactgggcatggtggcgggtgcctgtaatcccagctactcgggaggctgaggcaggagaatggcgcgaacccgggaagcggaggttgcaatgagctgagatcgcgccattgtactccagcctgggcaacaagagtgaaactgcgtctcaaaaaaacccaaaaacaactgctaacctttctgtgcttaatatatggtacatgatcaagatggagtaatacagtattctccatggaatcataatgttttagggtgttagaacttcctgactaaaacatttacagatgattttgttgttcaattaacgaagaactgatactggtataatttgatcacctaggcttgtggttcctacacggggatgtagtagccttctcgaaacagacatttgagctcctctggctttcatccgagcttctggtgtttagtaggaaatagtctccgaagtgcaggtcatgtagtcctagtgttttatagttataaagctgaattgttcttacaggagttacagaggtctataaagaaaatgtccataatctctctgtcttcaagttctagttccttagccctaaagtcagcaaagttaacatttggtgtccattattcccacacttttctctttgttcatatcatcgtgtataaacatatacacaggctgggcatggtggctttcacctgtaatcccagcactttgggaggctgacgctgaggtgagaggattgcttgaggctaggagttcaggaccatcctgggcattaagggaagaccccatttctacaaaaaataaaatattacagctgggtgcagtggtgtgtacctgtagtccgagctactcggtaggctgaggcaggaagattgagcccaggaatttgaggctgcagtgagctatgattgtgccactgcactccagcctctatgatagagggaaaaaaaaatccatatacagacattgattattttatttttctttatggaagtgggattatattatgcgtgtaatttttataacttttcttaacagtatgtgagggtcatccttccagatcattacatatagctctaacattgttaatagctgcgtgatgctctataatactggtataccctatatgccacttattaataaacttaagttactttcattttttccatcataagtaagactgcttaatcattggaataataatagattttgttaaaaaggcacccctttggtataaatctcaaatggccactattttagaaacattaacatggaaaataatatttcttctaaagttaagattaacagaactgactttaatttgttttattttagttattagatcttttgatgtcaacaaacctggctgtgaagttgatgaccttaagggaggtgtagctggtggtagtatcctaaaaggagtattaaaggtaaaatgggttttggttgttgtgattttgggttttttttttttgttgtttgtttgtttgttttatccttgtcttaatcaggaaaaaaagtatggacaatccaaattgaaaaataaaattttttccatggtttctggtatttgatgtagagttctcttttttaatattctttttttctctcttcaaacttcactcctcccacccttctagacctctgaatccacaatctaccttcatgagatccacctttttagcttccacatatacagatgagtgagaatgtgtgatatttgtctttttgtgcctggcttattttacttaacaaaatggcctccaattctagatgtgctgctgcaaatggcagaatttttttttatggctgcataatacttcattgcatatatatatatgctgccattgcttttcttttcttttttttttttttcttgaggcggagtcttgctgtttcgcccaagctggagcgatctcagctcactgcaaccttcacctcctgggttcaagcgattctccctgccccagcctcccaagtagctgggattacaagcaccccccaccatgcccagctaatttttgtatttgtagtaaagacagggtttcaccatgttggccaggctggtcttgaactccttacctcaagtgatccacccgcctcggcctcccaaagtgttgggattataggcgtgagccactttgcccggcctatatactgcattttctttatccattcatctgttcatgggcacttaggttgattccatgtttggctattgtgaactgtgctacaataaacatgggagtgcagatacctctttgataatattgcttccctttctggtgaatgtatacccactagtgaaactgatggatcatatggtagctgtattttcaggttttcaaggaacctccatactgttctccatggtagctatactaatttacatgctctgataatagttttttttttgttttgttttttgagcacagtggcatgatcttgactcactgcaacctccacctcctgggttcaggtgatgattctcctgccacagcctcccgacttgctggggctacaggcactcgcaacctcgcccagctaatttttttggtagagatggggttttgccatattggccaggctggtctcttaactcctgacctcaggtgatctgcctgcctcagcctcccaaagtgctgggattacaggcataagccaccacgcccagctatatttctttgttttctgttatgtcttttgaatgtgtctgacttgaaaatttatagacttgtaagtatggagcacatttgatgtggtaatagacttgtgtggtgggtagttaacaacagttggatggttctggttttgacagtctcgttcacatctttttttttttttttttttaagaataatgatctttgaaatacaggaatgattgccttttcagttttatggtcttccggttggacctttattattattttattttattttatttttgagacagagtctctctttgtcacccaggctggagtgcagtggtgcgatctcggttcactgcaacctctgcctcccaggttctagcaattctgccgcagcctcctgagtagcagggattacaggtgcgtgccaccacacctggctaatttttgtgtttttagtagagacggggtttcactatgttggctgggctggtctcgaactcctgacctcaggtgatccacccgcctcggcctcccaaaatgctaggattacacatgtgagccaccgcacccagtccctgttggaacttttgataggtaaatgataattttgcgtaacacagtaattctaattactaattatatgtttacaggtgggccaggagatagaagtaagacctggtattgtttccaaagatagtgaaggaaaactcatgtgtaaaccaatcttttccaaaattgtatcactttttgcggagcataatgatctgcaatatgctgctccaggcggtcttattggtaaggatttttttctcatctcttttaatttgtggctatttgtggtacttttcatgggggatggattaccaaaagggacatattacagatttttaattgggtattttaataatagagtagggtggggaacaatcatgtggttaagctcttgttttaggttataagatggtttcatgggtttgtaaaaattatttttaaacacaaaggatacattttgatcaaatatagagtaactcctttttagcaatataaaaaaataaatttgatgacttatcatgtaagatatttacctacacttatgtttttgttaacatgatttttgtgctagataatggttgccttttttttttttgggagatggagtctcgctgtgtcctccaggctggagtgcagtggtgcaatcttggctcactgcagcctctgcctcccaggttcaagcaattcttatgcctcagcctcccgagtagctgggactacaggcacatgctgccaggcccagctaagatttttgtattttagtagagacggggtttcaccgtgttgcccaggctggtcttgaactcctgagctcaggcagtccccctgcctcggcctttcaaagtgctaggattacaggcgtgaaccaccatgcccggccatggttgcttttatgtatattttgcaaatggaaaattacctacaaatgtcagttgaatgatatcaggtcgtatttccaatgaggtagaaataaaagaaagtaaatttctttgtgtagcaattactgaagtgatttaaaaacttttctagtcccttacaacttagtgtattactcaatacccagaaaaatgaaagattcagtgagaattagaaggggtgttgtacctttagattaaagaagaaaatgtttggtaaagaaacagttaattcttcacccaataagttgtgtctctggttgaaaattttaaaaaggaaataaaagaaaacaaaaaaatgaaaaagagtttaccaggttggctgggcgcagtgtctcatgcctgtgatcccagcaatttgggaggctgaggtgggtggatcgcttgagctcaggagtttgagaccagcctgggcaacatggtaaaaccttgtctctactaaaaatacaaaagttagctgggtgtggtggcccacgcctgtaatcccggctactcgggaggctgaggcatgagaatcgcttgaacccagaaggcggagggtgagccgagatcacaccagtgcactccagcctgggtgacagagtgacactctgtctcaaaaaaaaaaaaaaaacaagaagaaaagaaaagaaaaaatgaatttaccaggttgggtatggtggctcatgctcataattccagtgctttgggaagctgaggtgggaagattgcttgagaccaggagtttgagaccagcctaggaaaccatgagatgccatttctccaataaaatagtaagattagctgggtttggtggtgtgtgcctgtagttccatctatcattttatcttttgtgtgcatgtgtgtggtaaacaagggaaatctggaaactttttaaaaatttaacttaaggaacttttttaatttcttttttttttttttttttttttgaggcagagtctcattctgccacccaggctggagtgcagtagtattatctcggctcgctgcaacctttgcctcctgggttcagttaattctcctgcctcagcctcccgagtagctggaactataggcacataccaccacagccagctaatttttgtatttttagtagagatggggtttcgccatgttggccaggctggtctcgaacttctggtcttaagtgatctgccctccttggcctcccaaaatactgggattacaggcgtgagccaccacacttggcctaaggaactctttaaacataggatagaatactgtaatgataacccccatagagccatcactcagcttcagcaattattaatgttttaccagtcttggctgggcgtggtggctcatgtctgtattcccagcacttcgggaggccgaggtggacggatcacctgaggtcaggagttcgaaaaaccctgtctctactaaaaatacaaaaaaaaaaaaaaatttagtcaggtgtggtggcacatgcctgtaatcccagcctgtaatcccaggtcacagtgagccgagatcacaccactgcactccagcctgggcgacagagactgtgtctcaacaacagcagcaaaaaaaagttttcccaatcaatcttgctccatctatatatcttctttcccctactcccctcaagacacagctagaatattttgaagtagatcccaggaatcatatgtagtttttttttttttttttttttttgagagtctcactctgtcgcccaggctggagtgcagtggcacgatctcggctcactgcaacctctgcctcccaggttcaagtgattctcctgcgttagcctctcgagtagctgggattataggtgtctgccaccatgcccagctattgtatttttagtagagattgggttttgccatgttggctagacttgtcttgaactcctgaccttaggtaatcctccaacttgggcctccccaagtgctgggattataagtgtgagccactgcgcctggcccatatgtagtctttaactatcttttcaatcagtctttcaggggagaaatggcatgcaggtattctgcaaactactcattttgaattttgtattctttcggtctttgttaaggatattcggactcattttgagttcacttattatctctatttgccctttgtttagaatttattgttttcaagaccaggtcagtaatacttaccatctcctgcattaagttctcagccaagccatcattcctagaaaatcagatttctaaaccctttgtttagaatttaaatcaagagaatcgttctgttctcatttgcccagtcatctcatgagtgtatatttctatttgtctagataaaacaggtattttcttgtacctatatagctattatatgagtataaaaataaaagtatgaaagtgtgtaggtatatgctgtgcttatatggctttggggtatctaattcactttttttttttttggagacagagtctcactctgtcacccaggttggagtgcagtggtgcgatctcggctcactacaacctctgcctcctgggttcaagtgattctcctgcctcagcctcccaagtagctgagactacaggtgcacgccgccacgcctggctaattttttgtattttaatagagacagggtttcaccgtgttgcccaggctggtctttaactcctgagctcaggcatccacctgcctcggcctcccaaagtgctgggattacaggtgtgagccactgcacctggccaactaattcactttataggtgttttaggaaataaaaaattgagctatatacatcttatttttatataggagttggaacaaaaattgaccccactttgtgccgggctgacagaatggtggggcaagtacttggtgcagtcggagctttacctgagatattcacagaattggaaatttcctatttcctgcttagacggcttctaggtgtacgcactgaaggagacaagaaagcagcaaaggtaaatgcttttttaaaaattcctgtttctaaaaaagtgacaaatgggagtgttaaaccagtgttgagttttattgttttacagttaacatgaaattaagaaaaaaagaaaaggtaaataaatttgacctccccaaaattgagggtttttttttttttaatttagagatggagtctctcgctctgttgcccaggctggagtgcagtggcgcgatctcggctcacggcaacctccacctcctgggttcaagcaattctcttgcctcggtttcccaagtatatgggactacaggcacgcaccagcacgcccagctaatttttgtatattttagtagagatggggtttcactatatgttagccaggctggacttgacctcctgacctcaagtgatccgcccgccttggcctcccaaagtgctgagattacaggcatgagccactgcgtccggccaaaattgagaactatatggcagttagtttaagaaagaaacttaataaacagggaaaagtattagccatttatgacaaagacatgatattcctaaaatccatatttttgttttgttgtttattttgagacagagtcttgctctgttgcccaggctggagtgcagtggtgcgatctcgactcacagcagcctcgatctcccagctcaagccatcctcccaccttaacctcctgagttgctgggactacaggtgtgggtcaccacgcctggctaattttgtattttttgtagagacggagttttgccgcattacccaggctgatctccaactcctgggcttgagcaatctgcccaccccagcctccgaaaatgctgggattaacaggtgtgatccactgcgcccagcttcatgatttttaaaaaatgtcccagattaggttggcagagatgggaaattgctgacacctagtgttggcaaagattgaggaaaataagctatcatgcttttttttccccccactcaggtgatctgccttcctcggcctcccaatgtgctgggattacaggcgtgtgccactgcgcctggcccatattaactcttatatagccatagtccttcatgctcccctctttgggaaattttgtacctcatttgtactaggtaactgcttcagaattttaagaggtactctggtacggttactaccctattttttaaaggtagatcttgtgtaaattcagtgggtgccaaataaactatactatatatagttcaaattcctttacaatgaaatttctatagaattttttttatgattgacatatttcccaatagtatttggtaaattcttacttacatttggaaagcattttcttgattttggggtttatttttccctaatttatttttctaggttcaaaagctgtctaagaatgaagtgctcatggtgaacataggatccctgtcaacaggagggagagttagtgctgtcaaggccgatttgggtaaaattgttttgaccaatccagtgtgcacagaggtaggagaaaaaattgcccttagccgaagagttgaaaaacactggcggtaagtttgttagtctttgccactgtctaattaaaaaaagacacagtcttgtacagaaaaaaaagcacacaatcttccttgaggacaacagttactgtggctttcagtctcaactatttatttggatgactttgaaaactatacttcggccgggtgcggtggctcacgcctgtaatcccagcactttgggaggcctaggcgggtggatcatgaggtcaggagatcaagaccatcctggctaacatggtgaaaccccgtctctactaaaaaatacaaaaaattagccgggcgtggtggcgggcgcctgtagtcccagctactcgggaggctgaggcaggagaatggcgtgaacctgggagtcggagcttgcagtgagccgagatggcgccactgcactccagcctgggcgacagagcgagactccgtctcagaaaaaactacaaccttgactatagtcccatattttagtccaaatactgtgattggcttctcttcctgttagacacaacctatgcaaaaccaaatgaatttgggttcggtatttctatcgtcattggctttggaaatcatttcacacttaatagaaaaattgtaagagttttacagaaaactcctctatagctttttcctagattgacaaacacacatacagatttatttacatatataagtttttttctgaaccatttgagtgtaggctatatatgttatgcttcttgatctcttaatacttcagtgtatatttcccatcaaaaaaggatattcttatgtaaccacttagaaatttaacattggcaaaatactgaaatctacagtgcatgtttcagttttattacttgtcccaataatgtactttatgttcctcctgtttagaatcttgaattgcatttaatttcatgtctctttgatctttaatctggagctttttcagcctttgtcttaattgacattaacagttctgaagaatacaaactagttactttatagaatattcctcaatttgggtttttcttatcattcggaagcctaacattagattcagttatatattcttaacttaaatacaccgtgaagtctccttttcaggaatcacagctagaggcacatgatatctgactgctcctctttgttaaggttagttttgactatgtagtcaagatgttgtccagcttctctgctgtgtagttactctctacccttgcaactaataagcaatctgtagggagatctttctagccagtacaaatagcctgctgatcattgaatcccacacccctggatgtagcatccactgatgattcttgcctgaatcgaacttgactataatgattacaaaatcatagcacctctacgggttgcagtatcctccctcaactctaccaccccacatttatcatttggcattctttctttgccattatttatttccctatctagttataatatggactcatggagtcctattttattcaacatgttatgatccatcactgtcttcctttattttgatgtgcattgttcgacgtttggccagtggaggtccttcaggctggctcttgtgtccttttgacatgtactcatcatttttttttcttcttctttttttttttttttttttttgagatggagtcttgctttgtcgccggggtagaatgcagtggcatgatctcagctcactgcaacctctgcctcccaggttcaagcaattctcctgcctcagcctcccgagtagctgggactacaggcacacgccaccacacccggctaatttttgtattttcagtagagacggggtttcaccacgttggccagcctggtctttaacccccgacctcaggtgatccgccctccttggcctcccaaagtgctgggattacaggcatgagccaccacgcctgacctctttcttcttttttttggaacatttccttattttctggcacaaaatcttccagactcatcttgtaccttctctgttccagttttagaactggccatttctcttataaatgaaaagctgagtgttcaggtgtgctcatggctcttagggtgctgttgcttctaggtcttttgagagcatagagccaggaagcatacacacatttttggctcctgactttttgctctttcccaggttattgagtttgccccttgctttccattcctcgtcacctcatcacagtccataccaccatcactttacacttcacagttagtgcgaaagactcctagtttgcctcttaacttggtcaaaattagtcttcttaaaacattttcatcatgctgtgtttaataatttctagagtcttctcactactttttgatatttgggacttttctagaaacctgcttcaacccatttaagctttccttctgcattgtcttatataaaccctctaaattagactgttttgtgccctaactgtccccataattattcacatcacccctacccactatctacttccttaattatttattttatattttttagaggcagggtctctctgttgaccaggctggagtttagtggcatgatcatagctcactgcagcctcagtgtctaagtagctaggactattggctcacaccaccgtgatcagctaatttttttgttttttgtagacacttggtctcactgtgttgcccagcatgatctcaaactcctggcctcaagccatcctcccacctcagcctctcaaagtgttgggattacagacatgagccaccccgcccagccctgtttcctttattaaggcttccatgctactgtgcccacgatggtctcatcacttgtccaggagatttatctgaattattgccctgtaatttagaaagttaaatttttgttgtctcttaagtaaataattatttgtggtgacttatgcccttttgattttactgtcttttgtgattatatttttttgctattacagacacacgacttccagtgtattttgaaatagatttaagcaataaactttcagtccaggcacggtggctcatgcctgtaagcccagcactttgtgaggccgaggtgggcggatcacttgaggccaggagttcgcaaccagcctggccgacatagtgaaaccccatctctactaaaaataccaaaaaatcagccgggcatggtggcgcatgcctgtagtcccagctactcgggaggctgaggcatgagaattgtttgaacccaggagccagaggttgcagtgagccgagatcgtaccaccgcactccagactgggtgacagagtgagactgtctcagaaaaaacacacaaaagcaagaataaaaaagaatctaagaatatagtgtgggctttctttatggaggagcaggctttgggaacaaatttgaattcagaagataagcaggtaaaatttatcacaagattgtgtggtaatgagagtgaagtggatgtaagatttatgatttcttttattttcattttgcagtttaattggttggggtcagataagaagaggagtgacaatcaagccaacagtagatgatgactgaagaataccagttaaataatacattcggatggatttggaagttggaattcctcttaacaaccaaggggtttattttcaaagcaatattggggaattgatttcacagttcgttaccttagtaggtaacggtaaggttattctctttttttttttttttttttttggttatgaaaacttagggactaaaattaatataaaaattggcataatgttggattgaatctacattttggcagaagttaaacattcccacataatgtcaaaattatacatcatgcagttctgtttttttgtttgttttattttgttttgtttttgagtctggctctgtcacccaggctggagtgcagtggcgtgatctgcaacctctgccccccgggttcaagcgattctcctgcctcagcctcccgagtagctgagattacaggtgcgcgccaccacacttggctaatttttgtattattagtagagacggggtttcagcatgttggctaggccggtctctcctgacctcagggtgatcagcccacctcggcctcacaaagtgctgggattacaggcgtgagccaccttgcccagcccacatcatacagtttgaaatgaaactttgccacaaccagcctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaa

SEQ ID NO: 5543 - DNA, 3429 bp, human
cagctccccggcacgggcccgccgtcagcacgtcacgtcaccgcccgggagagagacccaggaaaatgcggaagggtagacaggccccctcctccgcccggtgggtcctcctggcaccccgtgtcggcgccgctcccgccccgcgaccggggagcccagtggcctcgctgcggcggggtctccggcggccggagtctccgtgacagcgccccccttctttccacctcctccgcgctcccgcccgccgccgccacacacgcgccgctgccgccgccgcctcggccgtaaagcccgcgcggggccgcggtcggccgaccccgcggagaggcaggcggcccggccgccccccaccatgtcccgtgggccgcggccgccccccgggggcctccctggagacctaccgcctctcgcgccggtcctggccgaggctccagctcgagttgtttgcaggccctcagacccccgcccgcagtaaatgtgttttcttcatccccgtggctggggaggaagataaatttagcaacccccgccgtcccctgccttcgcttaaaaaaaaaaaatctttgaaataaaatgaaaacgggcttgccagtctaaatgggtgtgcgggaaggggggtggagtggggggagaagggttatccctagagcacctaccaggccgtctactttttaaaaataagcagtcagagccaaactgattttattagtttgtacgggggagggagatgagcaaagttgcattttgaaacgtttcgcacgttgcaaagaacaggaattttctgtgtattttcctatgtacccgtgtttcagagcttgggagcctgtgaaatgtaagactggtgtcatcgtttcataaatcatgaattttccacattccttaatagagaggagcccaattgggtatggatttttttttttttaaacacactgcttaaacaagccttttgaagtttcaaaagacttgggagagaaggggaaaatgattaaacagcacttaccaacttcaaaaatgtgtatttcgcactttacttagtttaaatgtttatgctatctttccatgctgaacttggaacccaaactctgttttaaagttactagggaaaagttaaatagtggagtctttacattaatctggaatctggcatgctatcctttaacacagcactaaatgttaaaggcatttttaaacaataagaaacacaaaaattataaagcaaatagtatactggtgtgaaatctctttaaatacagaggccacgtattttagttgcctgacataactctttaaaactcccagaatgcaatttgtcccttccctcagacatctctcaatcacaaatgctttcaaaaaggaaaaacaaaagtagagtaagaagaaatctctgagcatgcactggatgataattttcctctcggggctttagtctgaatttttccaagcgattaaatttcctttcaaaaatagtaacagcatgtattcattgtttataaaaattacatcaggctgtgatagactttcacagaaagacatttcacagaaaggtaaatgaaactaagcaatgttgtttcaataaaaaaaaatgagaaatagcttgtgtgcccacattaatatttcttgcactcccagactggagtgcaatggcgtgatcttggctcactgaacctctgccttcggggttcaagcgattctcctgcctcagcctcccgagtagctgggattacaggcacttgccaccacgcctggctaatttttctatttttttagtagagatggggtttcaccatgttggccaggctggtctccaactcctgacctcaggtaatccacccgcctcggcctcccaaagtgctgggattacaggcgtgagccaccgtgcccggccgcccacattaatatttcaaaacattgataatcagcgtttaagtactttccaagggcctcagtgtgatgctacggtatggcaagaatggaggccaggttccctggttcagtcctgtaatcacagcactttgggaggccgaggcgagaggatcacttgagcccaggagttcaagactagcctgggtaacatggtgagacctcgtctctattaaaaaaaaaaaaaaagaagaagaatagagcctcacttcatccatgcaactgtaagcagcatgttcaagacagaaaaacctaatgtcaccattcttgttagtttttccataattaccatcaaaaatacttatacatccaccagtgtaaagcacttaagaaaacagtgtccaaggagcatgaaagaaaaagaagttttctcagtttaaaagatcacaagtagtttagggattgatactttcaaagagccctttgtcattacttttcatacaggaagagactgttaactttggtgggaaacaaagaaaggatggcctagttctattagattagataaacctttattaaagtccagcaaactttataaagtccagttattttatagatgactatacagataaggtcaactatattttttttagttaaaaaaaggtaaagttgtactttaagcccatttatggaagtctgtaaagaacattgtttaactggtaaaagaacaatggtaaaaatcatttcactagaagtacacttagtattatactcatgataaagtgaagatgaaaaggaagtgtaaacagcagagatcagaaattgtttgatgtgacaaaatacaaaatgcattttatgaaagtactcacaataggaccttgaggacacctaagatccttgaaagcatttggtaattaagcaccagacatcttgcacttaaaggacctactgcagcctatcttgccttgataattgttttcgtattagggacctttagaattctgggcacaggaagtaacaaagatgtgcttgcccttggggaactcgaataaggaggctgtgtaaggcaaaataaaaacattcctaagtactttcattttctcacttaagtaaacataataaaaggaaattttatctagggaggtcgagagcagaacatttcaaaagagaatgctatgaatacaaaatagctggtttcaaagcagtaaaaggaattttgattacgtgctaaaatgtatttgttccttcagagctgttaatgtacatcagatagttaaaagcatttactcaaggttttgacagtgttttaataaattaactaaaaatctctgacatgtttataggtccttgagccagaaacgatagaaggcctttcaatcatttttccagagaaagattagtcagaaaagaagctgttgattttcactccacatcggagactgatgggaattcaaataagaagcaataaattattggcttatgagaaaatgtagaccttcttgaataaagttgtggtaattctttttttttttttgtatcccaaacattaaaaaatatttatcttcccct

SEQ ID NO: 5544 - DNA, 114590 bp, human; identical to SEQ ID NO: 4445

SEQ ID NO: 5545 - DNA, 85316 bp, human; identical to SEQ ID NO: 4444

SEQ ID NO: 5546 - DNA, 85394 bp, human; identical to SEQ ID NO: 4443

SEQ ID NO: 5547 - DNA, 84637 bp, human; identical to SEQ ID NO: 4446

SEQ ID NO: 5548 - DNA, 12254 bp, human; identical to SEQ ID NO: 3308
